US006355411B1

(12) United States Patent
Ausubel et al.

(10) Patent No.: US 6,355,411 B1
(45) Date of Patent: Mar. 12, 2002

(54) VIRULENCE-ASSOCIATED NUCLEIC ACID SEQUENCES AND USES THEREOF

(75) Inventors: Frederick Ausubel; Howard M. Goodman, both of Newton; Laurence G. Rahme, Brookline; Shalina Mahajan-Miklos, West Roxbury; Man-Wah Tan, Somerville; Hui Cao, Malden; Eliana Drenkard, Cambridge; John Tsongalis, Southbridge, all of MA (US)

(73) Assignee: The General Hospital Corporation, Boston, MA (US)

(*) Notice: Subject to any disclaimer, the term of this patent is extended or adjusted under 35 U.S.C. 154(b) by 0 days.

(21) Appl. No.: 09/199,637

(22) Filed: Nov. 25, 1998

Related U.S. Application Data

(60) Provisional application No. 60/066,517, filed on Nov. 25, 1997.

(51) Int. Cl.$^7$ .......................... C12Q 1/00; C07K 14/21

(52) U.S. Cl. .......................................... 435/4; 530/350

(58) Field of Search ............................... 435/4; 530/350

(56) References Cited

FOREIGN PATENT DOCUMENTS

| EP | 0 421 382 A1 | 4/1991 |
|---|---|---|
| EP | 0 843 011 | 5/1998 |
| EP | 0 843 014 | 5/1998 |
| EP | 0 843 016 | 5/1998 |
| WO | WO 96/30053 | 10/1996 |
| WO | WO 97/38714 | 10/1997 |
| WO | WO 97/38722 | 10/1997 |
| WO | WO 97/39011 | 10/1997 |
| WO | WO 97/39017 | 10/1997 |
| WO | WO 98/20157 | 5/1998 |
| WO | WO 98/50080 | 11/1998 |

OTHER PUBLICATIONS

Conrad et al., "Efficacy of Aztreonam in the Treatment of Skeletal Infections Due to *Pseudomonas aeruginosa,*" *Review of Infectious Diseases* 13:S634–S639 (1991).
Cohn, et al., "The effect of amiloride on pigment expression in a clinical isolate of *Pseudomonas aeruginosa,*" Abstract, Apr. 1992, vol. 51, No. 4, pp. 562–567.
Molinari et al., "Inhibition of *Pseudomonas aeruginosa* virulence factors by subinhibitory concentrations of azithromycin and other macrolide antibiotics," *J. Antimicorb. Chemother.* 31:681–688 (1993).
Rahme et al., "Common Virulence Factors for Bacterial Pathogenicity in Plants and Animals," *Science* 268:1899–1902 (1995).
Bloch et al., "Pathogenicity Island Evaluation in *Escherichia coli* K1 by Crossing with Laboratory Strain K–12," *Infection and Immunity* 8:3218–3223 (1996).

Blum et al., "Gene Clusters Encoding the Cytotoxic Necrotizing Factor Type 1, Prs–fimbriae and α–Hemolysin form the Pathogenicity Island II of the Uropathogenic *Escherichia coli* Strain J96," *FEMS Microbiology Letters* 126:189–195 (1995).
Carniel et al., "Characterization of a Large Chromosomal "High–Pathogenicity Island" in Biotype 1B *Yersinia enterocolitica,*" *Journal of Bacteriology* 178:6743–6751 (1996).
Censini et al., "cag, A Pathogenicity Island of *Helicobacter pylori*, Encodes Type I–Specific and Disease–Associated Virulence Factors," *Proc. Natl. Acad. Sci. USA* 93:14648–14653 (1996).
Finlay et al., "Common Themes in Microbial Pathogenicity Revisited," *Microbiology and Molecular Biology Reviews* 61:136–169 (1997).
Groisman et al., "Pathogenicity Islands: Bacterial Evolution in Quantum Leaps," *Cell* 87:791–794 (1996).
Groisman et al., "How Salmonella became Pathogen," *Trends Microbiology* 5:343–349 (1997).
Hacker et al., "Pathogenicity Island of Virulent Bacteria: Structure, Function and Impact on Microbial Evolution," *Molecular Microbiology* 23:1089–1097 (1997).
Kovach et al., "A Putative Integrase Gene Defines the Distal End of a Large Cluster of ToxR–Regulated Coloization Genes in *Vibrio cholerae,*" *Microbiology* 142:2165–2174 (1996).
Lee. "Pathogenicity Islands and the Evolution of Bacterial Pathogens," *Infections Agents and Disease* 5:1–7 (1996).
Mahairas et al., "Molecular Analysis of Genetic Differences between *Mycobacterium bovis* BCG and Virulent *M. bovis,*" *Journal of Bacteriology* 178:1274–1282 (1996).
Marschalek et al., "Tranfer RNA Genes: Landmarks for Integration of Mobile Genetic Elements in *Dictyostelium discoideum,*" *Science* 244:1493–1496 (1989).
Mel et al., "Modulation of Horizontal Gene Transfer in Pathogenic Bacteria by in Vivo Signals," *Cell* 87:795–798 (1996).
Ochman et al., "Identification of a Pathogenicity Island required for Salmonella Survival in Host Cells," *Proc. Natl. Acad. Sci USA* 93:7800–7804 (1996).
Rahme et al., "Use of Model Plant Hosts to Identify *Pseudomonas aeruginosa* Virulence Factors," *Proc. Natl. Acad. Sci. USA* 94:13245–13250 (1997).
Ritter et al., "tRNA Genes and Pathogenicity Islands: Influence on Virulence and Metabolic Properties of Uropathogenic *Escherichia coli,*" *Molecular Microbiology* 17:109–121 (1995).

(List continued on next page.)

Primary Examiner—John S. Brusca
(74) Attorney, Agent, or Firm—Clark & Elbing, LLP

(57) ABSTRACT

Disclosed are bacterial virulence polypeptides and nucleic acid sequences (e.g., DNA) encoding such polypeptides, and methods for producing such polypeptides by recombinant techniques. Also provided are methods for utilizing such polypeptides to screen for antibacterial or bacteriostatic compounds.

6 Claims, 133 Drawing Sheets

OTHER PUBLICATIONS

Shea et al., "Identification of a Virulence Locus Encoding a Second Type III Secretion System in *Salmonella typhimurium*," *Proc. Natl. Acad. Sci. USA* 93:2593–2597 (1996).

Sorensen et al., "Phenazine Pigments in *Pseudomonas aeruginosa* Infection," In: *Pseudomonas aeruginosa* as an Opportunistic Pathogen, Campa et al., eds., Plenum Press, New York, pp. 42–57 (1993).

Swenson et al., "Two Pathogenicity Islands in Uropathogenic *Escherichia coli* J96: Cosmid Cloning and Sample Sequencing," *Infection and Immunity* 64:3736–3743 (1996).

Turner et al., "Occurence, Biochemistry and Physiology of Phenazine Pigment Production," *Advances in Microbial Physiology* 27:210–275 (1986).

BI48 SEQ ID NO:1

```
ATCGCCGATCCAATGCCAAGGAGTACCTGGGCAATCAGAGCCTACTCACGGCTGCCGGGGCCGGCATTGCCAAGCTCCTG
GACGCCGACGAGAACAACACCAGTACCGTCTTCAGCGGCAACGGCACCAGCTTCGGGACGACCGGAACCAACAGCAACTC
GGCCCTCAACAGCATCCTCTCCGGCGGCGTCAGCGACATCCGGCAGTGGATGAACAAGTTGTACGGGGAGGCCTTCGCCG
CCGTCTACGTGCAGCCAGGTGCGCGGGTCGCAGTGCATCTCGATCAGCAACTGGCGATCGACTATGAACTCAAGGGCCGC
AAGGTCGATTACAGCTCTGGAGCCGCTCATGCAACAGCAGACTTGGACTAACCCCCTTCTTCGTCTCTGCGCCGGCCTGG
CCTGCGCGCTGACCCTGGCAGCGTGCTCCACCAGCAAGGAGGAGATGCTGCCCCACGGCGAGGCCAACATGCTCGACGTC
TGGGAGCGAGGTGCGACCAGCTCGATAGGCAACAGCCGTGGCCGGCTGCTCCTCGATGCCAGGCAAACGCTGCGGCGCCC
AATCGATCCGCAGCAGGATGCCTCCGCGAATGACCAGGCCGACTACACCCGCACGGCCAGCAACGAGATCCACAGTCAGT
TCAAACGACTGCCCAATCCCGACCTGGTGATGTATGTGTTCCCGCACCTGGCCGGCAGCGATCCCGCCCCGGTACCGGGC
TACACCACCGTGTTCCCCTTCTACCAGCGAGTCCAGTACGCCATGCCGGGCGAACGCACGGAGGACTATTGATGGGCTTT
TTTCAAACCCTTCTGCGCGGTCGCACACAGCCTCAGTCGGTACCGGCAGACGCTCCCGAAGATTCAGGAGCGCTGGACGT
AGCGGCCGCGGAAGAAGCGACTGAGCGCTATCTGGCGCGACTGGCCGCCATGGGTATTCCTCTGCCCAACACCGGGAGCA
AGAATGGCGCCACGCAGGCCGAAGCGTCACGCCTCTACGATCACGACCCATCGTTCGTAGACCTGCTGCCCTGGGCTGAG
TACCTGCCCGACGAGCAAGTGATGCTCCTGGAGGATGGGCGTTCGCGCGCCGCATTCTTCGAACTGGTGCCCTTGGGCAC
CGAGGGCCGCGATCCCAATTGGATGCAGAACGCCCGGGACGCATTGAAAGAAGCCCTGCAGAACTCCTTCGACGAGCACG
AAACCTCACCCTGGATTGTCCAGTTCTACGCCCAGGACGAGATCAGCTGGGACAATTTCCAGGAGCAGTTGAGGCAGTAC
GTCCATCCTCGAGCGCGAGGATCGGCCTTCAGCGAGATGTACCTGGCGCTCATGAAGCATCACCTGGAGGGCATTTCGAA
GCCGGGCGGACTGTTCGTCGACACCGCCGTCAGCAAGCTGCCCTGGCGAGGACAACAGCGCCGCGTGCGGATGGTCGTCT
ACCGCCGGATCCGCAAGGAGGATGCGCAGATTCGCGGACAGGACCCGGCGGCGTACCTGAAATCCATCTGCGAGCGTATC
CAAGGCGGCCTGGCGAACGCCGGCATCGTCGCTTCGCGCATGGGCGGACAGGAGATCAGGAACTGGTTGATCCGCTGGTT
CAACCCGCACCCGGATCACCTCGGCCAGGCCGAGGCGGACCTACGTCGCTTCTACGAACTGGTATGCCGTCCGGACGAAC
CGATCCTGCAGGATGAATTGCCACTGGCCGACGGCACTGACTTCTCCCAGAACCTGTTCTATCGGCAGCCTGTTTCCGAT
GCCACCCAGGGCGTATGGCTCTTCGATGCCATGCCGCACCGAGTGATTGTGGTCGACCAGTTGAACAAAGCGCCGCTGAC
AGGCCACTTCACCGGCGAGACGCTCAAAGGCGATGGCCTCAACGCCCTGTTCGATCGAATGCCCGAGGACACGCTGCTGT
GCATCACCATGGTCGTGACGCCGCAGGACATGCTGGAAGGGCATCTGCAGCAGCTCTCGAAAAAGGCCGTTGGTGACACC
CAGGCCTCGATCCACACCCGCGAGGACGTGGCCACCGTTCGACGCCTGATCGGCCGGGAGCACAAGCTCTATCGCGGAGC
GATCGCTCTGTTCGTGCGCGGCCGCGACCATACCCAGTTGGAGGAACGCTGCATCACCCTGAGCAACGTACTGCTCGGCG
CCGGCCTGGTGCCGGTCGAACCGCAGAACGAAGTCGGACCGCTGAACAGCTACCTGCGCTGGCTCCCCTCAAACTTCGAT
CCAAACGAGAAGCGAGCCCTGGAGTGGTACACCCAGATGATGTTCGCTCAGCACATCGCCAACCTGTCGCCCATCTGGGG
GCGCACCACCGGTACCGGACACCCTGGCTTCACGCTGTTCAACCGTGGCGGCGCGCCGTTGACCTTCGACCCGTTCAACA
AGCTGGACCGGCAGATGAATGCCCACGGCTTCATCTTCGGGCCAACTGGCTCCGGCAAGTCGGCGTCCCTGACCAACCTC
ATCTGCCAGATGCTCGCCATGTACCTGCCGCGGATGTTCGTCGCGGAAGCGGGCAACAGCTTCGGCCTGCTGGCCGACTT
AGCCAAGCGGTTTGGCCTCTCGGTCCACCGGGTGCGCCTCGCCCCGGGCTCCGGCGTCAGCCTGGCGCCGTTCGCGGACG
CCATCAAGCTGGTCGAGAGCCCCGACCAAGTGAAGGTGCTGGACGCCGAAGACATCGAGGCCTCGGACTCGGTCCAGGGC
AGCAAGGCCGACCTCGAGGACGACCAGCGAGACATCCTGGGCGAGATGGAGATCGTCGCCCGCCTCATGATTACCGGTGG
CGAAGAGAAGGAAGATGCGCGCCTGACCCGTGCCGATCGCAGCGCCGTCCGCCAGGCGATCCTGGCGGCGGCCAGGACCT
GCGCCGCCGCGAACCGCACGGTACTGACCCAAGACGTGCGCGATGCGCTCTACGAGGCCTCCAGGAGCGATAGCACCGCG
CCAGAACGCCGCGCGCGGATCGCCGAAATGGCGGAAGCCATGCAGATGTTCTGCATGGGCGCCGACGGCGAGATGTTCAA
TCGCGAAGGCACGCCCTGGCCTGAGGCCGACCTTACCGTGGTGGATTTCGCAACGTACGCGCGCGAAGGCTACGCCGCCC
AGCTCGGGATCGCCTACATCTCGCTGCTGAACACCGTGAACAACATCGCCGAACGCGACCAGTTCAAGGGCCGGCCAATC
GTCAAGATCACCGATGAGGGGCACATCATCACCAAGCACCCGCTGCTGCTGCCCTACGCCATGAAGATCACCAAGATGTG
GCGGAAACTGGGCGCCTGGTTCTGGCTCGCCACCCAGAACATCGACGACATCCCAGCCTCCGGGGCGCCGATGCTGAACA
TGATCGAGTGGTGGTTGTGCCTGAACATGCCCCCCGACGAAGTAGAGAAGATATCCAGGTTCCGCGAGCTGTCGCCGGCG
CAGAAGTCGATGATGCTCTCGGCCCGCAAGGAAAGCGGCAAGTTCACCGAGGGCGTGCTCCTGGCCAAGGGCAAAGAATA
CCTCGTCCGTGTGGTTCCCCCGAGTCTCTACCTGGCCCTGGCCATGACCGAAAACGAAGAAAAGAACCAGCGCTACAACA
TCATGCAAGCCACCGGCTGCGACGAGCTCGAGGCGGCCTTGCAGGTCGCAGCGGATCTCGACAAGGCGCGCGGCCTGCCA
CCCTTCCCCATTGTTTTCCCAGACCAACCGGCAGTGGAGTGCCAGGACGAATGAGAGTTCTGAATTCGCTGACCCAGAAC
CTGATCGACAACCTGACCCAGATCCTGCAGAACCCCGAAGAGGATGCCCTGCAGACGCTAAGGATATGCGCTCCTGTACT
GATAGAGGAGCTGCAGCAGATTCAACTGAGGGCAGTCGATCGCCGGGATATCGTCCCGCAGATAAAGCAGCTCTTGGATG
AATGGCTGCAACAACATCCACAGCCTGATACGGCCCAACAGGCGCTCATTGAGGCCGTGGACCGCGCGGAGATCCTACAG
CGGAGGCAAGCGTGAGACTCTTGAAGGGCGGCTGGGCAGCCAAACGATTTCAAGGTCCCGCCCTGCCCTGGGCGGGGCTG
```

Fig. 2A

```
CTGCTGGTCTTGCTGGCTGCATCCGCCGTAGGGGTAGAGCTTCTGGTGAAGGGCCTGCCAGCCAACCACAGCCTCTACGG
CGATGCGAAAGCGCGCTGGACGATCAATGAATACGCCGACCTGGAGTGCCCCTTCTGCAAGGTCTACACCCCGCGGCTTA
AGCGCTGGGTAGACAGCCATCCGGACGTGAACCTGGTTTGGCGCCATCTTCCCCTGCAGATGCATGGCGAGGCGGCCCGC
CACCAGGCTCGCCTGGTGGAGTGCGCGGGGATCCAAGGCGGCGCCAAAGCCTTCTGGAGCGCTATCGATGCGATCTTCGC
TCAGTCGGCCGGCAACGGGGGCGGGCTGCCTGGCGGCACATTGGACTTTCCTGAACTGGACCAGGCTCGACTGGAGAAAT
GTGCGAAAGACAACGAACTTATTGACTCAGATATCAAGTTGGACATCGACATTGCACGGTCGAAGGGCATTACAGCGACC
CCGACCCTCGTCATCCGGGACAACCAGACGGGACGAAGCGTGAAGCTTGAAGGCATGGCCGACGAGACCACGTTGCTGTC
GGCGATAGACTGGCTAGCCAAGGATCTCTAGCGTCGCGCCAAGAGACTCTTGGCTAAGAAATCGGCGAGGATTCCAACAT
CCCTCTTTTGGTCCTCCAGGATGCCCTGCACTTCACCTGGCAGAACCTCGACCTCCTCCCCATCCACAATCTTTACCATT
CTCTTGTGGCCGGAGCTGGTGAGGCTAAGCCTCAACTCCATTGCCGGCCGAGCATTGATGTAAATGCTCTCGAGCAAGCG
CTCCATGACTTCGACCACTCCTTAATATCAGTTAGCCAGCTACATACAGGAATTATGCTACCCAGGACATGCAGGCGTCA
CCCCTACTTATGTACGTGGCAGCGTTCGATCACGGCTCGAAAAAATACACCACCTACGAGTTGATGATTTCCTGCTGCCC
TATCGGAAGTGATCCTGTCTGCTGTCTGTACCTTTCTAGAACCGGTACAGACCCATGCCTCTTCATCACTCCCCCCTGG
CCGGCGGCCACCAACGCTGGCCGTTGGCGTACTACTGGTACTGCTGAGCAGCGCGAGTCAGGCCGAAACCTGGGTCATCA
CCGACAAGGCTCATCCGGTCTCTGCCACCGGATCGTCGCGCGTTCTGTTTCTGGACGCCCAGGAACACCTCGAGGAGCAA
CTGACTGCGGCCTTGCCCCAGGATCCACAGCATGCTCAAGCGGCGTTTAAGCGATTGCTACAAAGCCCCGATGGGCGCCG
CCTGCAGGCAGAGCTGGTCAAGGCACAACAAGACGTCGCCGATGCGTGGAGTCTCGGTGTCGAGAAGATCCCTGCCGTAG
TAGTCGATAGGCAGTACGTGGTCTACGGCGAACCGGATGTTTCGCGCGCTCTTGAGCTAATCGCCAAGGCCAGGAGGTCG
CGCTGATGACCAGCCTCAACCTCCGCCGCCTGGCAGCGGCGGCCGCCACCTTCAGCCTCTCGTTCACGGCCTCGGCCGCG
ATCAACAGCGCTGCCATCGTCTCCTCCACCCTTTCCCCTCAGTGCCTCGAATACAAGGTCGTCGGGATCTGTTACTGGCT
GCTCTGCGGCCCGCATGGCTGCAAAGTGAAGACGTCGGTCAAGGTCCGCCACTACGTGCCTGACGCAGTCGTCTCCAGCT
ACGCGAATACCGGGAGCAACCCCTGGACCGAGGTATCGGCGCTGGGTACACCGAATCCACTCGCCCAGGCCGGCAATGAC
GCGACCACAAACTACAAGGCCGAGAACAGCATCGGCCGCTTCAAGGAAGCGGATGTGATCGGCCATCCTGGTGGCGCCAC
GTTCAGCCGGTTCGCCAGCGCCTCTGGGTACGTTTGCCCTGGCGCCACCGTCCCGCTGGTGCCGTACTTTCTCAGCACAC
TGGACGCCATTGGCTGGCGGCATGGAATTCCCGAGCAGGTGTACCCCGAAGCGTTGGTCCCAGGGCTGCGCGAGGTGGGT
GGAATCTTCTCCGGCGACATGTGGGGGAACCTCTATCCGCGCAGCGGCTTCCTGCACCAGACCGACGACTACAAGACGGC
AGCCGTCATCGCCCAGCGCGCCGGCGATATCACCACGCGAATCGGCCAGCTCCACGTCTACCTCCCCATGCGCGCAGCCC
CCAAGGACGGCTACTGGCCGGCGGGCGAGCTGAAAGAGGGCGATGCCTCGACCGGGAAATGGCAGGAGCTGACCCCATCC
CTGAGCCTCAACTGCGCGGTGTTTCCCAACTCTGGGCCGAAGACGCAAGCCGTCGACGGGGAGCACGCCTGGGCGCTCTG
GCGTCCCTACTCCTGCTGCCAGCGCAAGGGGCAGATGTTCATCTGCAGTACCGACTTCCAATAAGGACACGGAGACGAAT
CATGCGAATGAACATCACCTCGGTCGCGCTAATGTGGCTGCTCGCAGCGCAACTTGCCCAGGCCGACGACCCGATCAACG
TGTCCAAGACCGGCACGGTGCTCAGCGACGAGGTCCTCTACAGCATTGGCGGCGGCAGTGCGGTGAGCATGGGCAGCGCC
GGCCAGATGGACTCGATCGGCGTCGGCTTCGGCTGGAACAACGACATGATGTGCGGAAACATGAACCTGAGCACCACCCT
GGAGAACCAGCTCAACGGTGCCACACAGGGTTTCCAGAACATCATGGGCTCAGTCATCCAGAACGCGACCGGCGCGGTCA
TGTCGCTGCCGGCGTTGATCATCCAGCGCGCGAACCCTCAGCTCTACAACCTGATCACCAATGGCATCCTGCAGGCGCGG
ATCGACTACGACCGCTCGAAAGGGACTTGCAAAACGATCGCCGAAAAGATGGCTGACATCGCTGGCGAGCAGACCGGCTG
GGGGAAAATCGCCGAAGGCCAAGCCCTGGGCGCCACACTGGCCTCTGACGGGAAAGACGCCGTATCCGCCCTCGAAGCAG
TGGAGAAGAAAGGCGGCAACGATGGCGTAACCTGGGTTGGTGGAGACAAGGCCGGCGGCTCCGGCCAGAAGCCCATTCGC
ATCGTCAACGACGTGACCCGGGCGGGCTACAACCTGTTGACCAGCCGCTCGGTGAATGATTCGTCGAGCGTGCCTTCCGC
CACTTGCAACAACGGCCTGGTCTGCAACACTTGGTCCTCCCCCAGGAGGCCGCCGCATTCGCCACCCGGGTACTGGGGG
AGCAACAGCAACAGACCTGCGAAGGCTGCCAGAAGACGGTGACGGCTGCTGGCGTCGGCCTCACCCCGCTGATCCAGGAG
ACCTACGACAAGAAGCTCCAGTCGCTGCAGGAGCTGCTGTCGAAGAGCAAACCACTGACTGCAGAGAACCTGGCTGCGGC
CGGCACCGATGCTCTGCCAATTACCCGCGGCGTCATCGAGGCGCTGCGCGACGAGCGTGACCAGGACGTCCTGGCGCGCC
GCCTGGCGTCCGATGTCTCCCTGATGGACGTGCTCAGCAAGGCACTGCTACTGCAGCGCCTGATGTTCGCCGGCGCCAAG
GAGCCCAACGTCGCCGCCAACGGCCTGGCCACCCAAGCCGTCGATCAGCAGACCAGCCTCCTGCAGCAGGAGATCTCCAA
TCTCAAGACCGAACTGGAACTCCGTCGCGAGTTGGCCAGCAACTCCCCCATGCGGGTCATCGAGCGCGGGCAACAACGCG
CCTCAGGGTCCAGTGGCGTGTTCGAGTCGGCGCCCGATGCCGATCGCCTCGATCGCCTGCAGGCCCCCTCTGCCGCCGGC
GGCAAGTCGGGAGGGAGACCGTGATGGCAGATACGCTCACCACCCGAAAGCTTCTCGGTCAGCTACTGGTCGGAGTGCTG
ATCGTCATCGGACTGGCAGTGGTCGGTACGCTGCTCAGTCTCTTCGCCCTGAACCACTTCGGTGGCATCCAGGGCCTGGA
GGCCTGGCGGCAAAGCAACTACTGGAGCTTGTTCGCCTGGCGGGCGCTGCTGTACTGCGCCCTGGCCATCGCCTGGTTCC
GGCAGCGCAAGGAACTGAGCGCGCATGAGCGGCAGCGCATTCGGCGGATCGAGATCCTGGTGCTGTTGCTGGTCCTGCTC
```

Fig. 2B

```
ATCGAATTCAGCAAAGCCTACTTCCGCACGGGAGGCGCAGCATGACCTTCATGACCAATGACTACCTGGAGTATTACCTC
ACCCTCCTCGGCTGGATCATCAACAACGGGATCTGGAACATGATCTCGGATACTGGCCTGTTCGCGGTGCCGTTCGCGGC
CATCGTGATGCGCGAATGGCTGAAAGTTCGTGGGGAAGGCGCCGACGAGGGCAACAAGGGAGTGCTGTCTCTCGCCCGCA
TCGAGACGCATATCTACGTCGGCTACATCGTGGTCGCCCTGGCGGGGATCCCGGTCGTCAACGTGAGCTTCGACACCATC
GAGTTCGACCAGACTCGCGCCCAGCAGTGCCAATACAATCTGCCGGCACCGGCGGACACCGGCTGGTCGAGCTCCTTCAG
CAGCCTGGCCGGCAAGAGTGCGCAGATGCCGCTCTGGTGGGCGATGATGCACGCCCTGTCCAAGGGCTTCACCAGCGGCG
CCATCGCGGCCATTCCGTGCGGCACGGATCTGCGGCAGATGCGAATGGAAGTGGACAACACGCGCGTGAACAATCCGCTG
CTGGCACAAGAAATCGCTGATTTTTCCAGAGACTGCTACGGGCCTTCCCGTGCGCGGCTGTTCATGCGGCAACCCGACCT
GGGCTCCGTCGCCGAGGACAACAAGGCGTTGCAAGACCTGAACTGGATCGGCTCCCGATTCTTGTTGAACACCCCGGGGT
ACTACGACACCGACTACTCGAAGAGTCCCCGTCAGTCGTGGCCCTACAACGCCACCCGCGATGCCGGCCTGCCTCAGGTG
GGCGGTGGTGGCGGCTACCCAACCTGCAAGCAGTGGTGGGCTGACTCAGGGATCGGCTTGCGTGATCGGATCAAGGACCA
GGTGGATCCGGACCTGATGACCAGCTTCCTCAAGTGGGCGAAATGGTTGAACCAGGACGAGGTGACCGAGGCTGTCATTC
GCCAGGTGATCTCACCCTCCAGCCAGGTCAAGGGTAACGTCTACACCGATTACGGCGGGCAGGTGGGCGGCACCGTGTGG
AACGGCATCGCGAGAACCGCAGGAACCTTCGGCGTTGCGGTGGGCAGCTTGGCATACTTCCCGGCGATGGATATGGTCCG
CCAGGCACTGCCGATGGTGATGTCGTTCCTGAAGATGGCAATGGTCATCTGCATTCCGATGGTCCTGGTCATCGGCACCT
ATCAACTGAAAGTTGCCATGACGATGACGGTCGTCTTCTTTGCGATGATGTTCGTCGACTTCTGGTTTCAGTTAGCCAGA
TATATCGACAGCACGATACTTGATGCTTTCTATGGTTCGGGATCACCACATCTTTCATTCAACCCAGTCATGGGGCTGAA
TACGGCTACTCAAGATGCGATCTTGAACTTCGTTATGGGTTCTATGTTCATTGTTTTACCACTACTGTGGATGACAGCGA
TCGGCTGGTCCGGAATTCAAGCAGGGTCTGTTCTGAACGGATTGAGCAGAGGGACTGAAGGAGTTCAAGCCGCCGGCAAG
GAAGCAGGAAATAGAGTTAAAAACGCAGTTTGAGGAAGTATAAAGCCATTACCGGGCTCTAGTCCCGGTAATGGTGTGCT
GCCTGATAGTCAAACAGCTCTGCTACAGATTCAGTTTCAGCTTGTGAAGTCATAGTTGAGACATCTCGACTTGGAGACCC
TTTAGAGACGGAGATGTCCCCTTTAACCAAGGCAAATCCCACCAGAAAGACACACAGTAGAGTCATTGATACCCCAGCAA
GCCACATAAAATTCTGTGACACTACAAGAGCTACTAACAAGAATAGGCTAACTCGCTTAACCCAACGTAGAGCTGGACGG
CGATCATGCAGGCAGAAACGCACAAGCATACCCAGACCAAAACCGATCCGGGAGGCAAAGCCTTTGTTGGTGTGCGCGTT
CATCATCAATCTCCTGGCTCCCAAAGGGAGGCATCCTGCTATCACCTATACGCCGAAAAAGATGATTTGGCAAGCATTAT
GGCATATTATGCCACTAGCTATCTGCCGACTGGAGTACCTCATGGCAACGCGAAACGTCGTCCTTCCCGATCCGCTGGAG
CAGGATATCAACGAGCTGGTGGAGACCGGCCGCTATCAGAATCGCAGCGAAGTCATCCGGGCAGGCTTGCGCCTGCTGCT
GCAACAGGAAGCCCAGATANGCGCCAAGCTCGAAACCCTCCGCAACGCAACATCCAGTGGGCTGATGCAACTGGAGCGCG
GCGAGTACGACGAGATCACCAGCGACGAACTGGCCCAATACCTCGACGAGCTCGGCAACCAGGCGAGCCACTGAAGCATG
GCCAAGTACCGCATCTCTCATGATGCCCAAGCGGACATCGTCGATATCCTGCGCTTCACCCACAACCACTTCGGCGATGC
CGCGCGCCGACGTTACCAGGCACTCATAGGGGCGGCGCTGGAAGCAGTTGCGACAGACCCACAACAGGTAGGCAGCATCA
GCCGTGAAGAACTGGGAGCTGGCCTGCGCAGCATCCACCTCGTTTACTGCCACTCGATGCCCAATGTCGGTAAGGTTGTT
CGGCCCAGGCACTTCGTCTTCTACCGGGTGGCGACAGACCAGGTGCTAGAGGTGGTTCGCGTGCTTCACGACGCCATGGA
TGTGGATCAACACCTGCCCCAACGATGAGCAACTGTAACAGGAGCAAATGGCCCAAAGGGGAAATGGGCTTGAAGGGCGA
AGGGAATGGTTCACAAGGGTAAAAGCCCTACCCGAAAGGGCCTGCCGGAAGGCAGAAAGGGCTGCGTTCGCGCCGGCGAA
CACGAAAAGGCTACGGGTGAACATCCACCAGCAGGTGCCCCATGGTTGATGCGCAATAGCAGTGGCTTGACCACTCGATT
GCATTCCCCCTGACCAAGCATTTGCATTCGTGCTGACCACCGCTTGCATGCGGCTTTACCAGTCACACCGTAGTCACGAC
CGGCTGCAGTCGACCCAAAGCGGACCTTTGTGACAGACCGAAATCGGCCAAAAGCAGACGCTCAAAAGCATCTACGAAAG
CAGGGACAATTCCGGGGGATACTCCTCTACGTACGTTGCTTATATCGCGGAGGAATTGGCTGAACCGCGGTGCGGAGAGA
TCTCCTCAAACTGATGGGTTGCACGCATATCGAAGCAGATTACATAGGAGGCTTGCGCTGTTCAACAGCTCCTGAGGGGA
CTTGGGTTGCCCATGGTTTCCACGGCCCAATCGTTGACGTCATTGACGATTCCGCTGGCTTTTTCAGTACGCATCGCTTG
GCGCTCCATTACCCAGCCCAATGCGGCCTTGCCGTTGACCAAGCGATTCCAAGGACTGCGATCCATGTAGCCAGCCCTCT
AATGCATGTATGTATAGGTAAGGTCGTCGTTATTTCGGCGTGGATGTGCTGACTGGAGGTTTAGCGTGGTGAGTCAGTAT
GTCGTGCGCTATATAAGTCTCATCTCGGCATCCGCACATGGATGCTGTTAGATTCAGCAAGTGGGAAAAAGCGCGAGCGC
TAAAAGGAAAGCTGCCGGCCGGCGTGCTCAGTAGCAAGCTACCCCGGCAACACTTAGGAAGAGGTGATCATGAAGTTACA
GGCATATCGGCTGCAGAACTACCGCCGGCTGCGCGATGTTGTCATCGAGCTCGATGACGAAATTTCTATCTTTGTCGGTG
CCAACAACAGCGGGAAGACATCCGCCGTCCAAGGCCTGTACTCAATGCTTCGCGGCGAAGTGAAGAAGTTCGAGCTCTTT
GACTTCAGTGCGGCGCTGTGGGCCGAGATCGATGCGGTCGGCAGGACGCCCCCTGGCGATGAGGATGCGCCCAAAAGGTT
ACCGTCCATACTCTTGGATCTCTGGTTCCGCGTCGGTGAAGACGACCTCGCCACTGCGATGTCGCTGCTGCCGAGCACTG
AGTGGGACGGCAAGTGCGTCGGGATCCGGGTAGCGTTCGAGCCTCGGGATGCCCACGAGCTCGTCTGGAAGTTCCATGAA
CTACATGAGAAGGCCAACAACGCAGCTGTCGCGCTTGCGGCCAAGCGCAAGGCCGCCGGGGAGCAAGCTGTGGAGGCGGG
```

Fig. 2C

```
CGCGGAAGACGCGGCTGCGGTGGTGGCCGATGCCGGCGAGTACAAGCCTTGGCCAGAAAGCCTGACGAAGTACCTCACAA
AGGAACTGAGCAAGGAATACACCTTCCGCTACTACGTGCTCGATGAGCGGGCTTTTGTCGGCTATCAGGCAAGGGAGGCC
GACTACGAGCCGCTACCCCTAGGCAAGGAGCCGGGCGGTGCAGCCATTCTCAAGTCGCTGGTGAGGGTCGACTTCCTGCG
CGCGCAGCGGCACCTCGATGACCCAGATGCCGGTAGCTCTGATCGCGCAGAGAGCTTGTCGCGGCGTCTGAGCAGGTTCT
ATCACCGCAACCTGGAGAAGCGTGGCGACGACCATGCGGCTCTCAAGGCGCTAGATACCTCGGAGAAGGAGCTGAACTTC
CACCTGAAGGAAGTCTTCAATGACACCCTCACGCGCCTGGCCAAGCTCGGCTATCCGGGCGTCAACAATCCGGAGATCGT
GATTCGGGCGGCCTTGGATCCGACCACTGTCTTGGGGCAAGACGCCAAGGTTCACTACGTGATCCCGGGCGTAGCTTCCG
CCCAACTGCCAGACAGCTACAATGGCCTGGGGTTCAAGAATCTGGTCTACATGGTGGTTGAGCTGCTCGACTTGCACGAG
CAGTGGAAAGCCGAGGATGACAAGCGAGCTCCGCTTCATTTGGTCTTCATTGAGGAGCCTGAGGCGCATCTGCACGCGCA
GATCCAGCAGGTCTTCATCAGGAACGTTTTGCGCCTCCTTGAGGATGCTAACGATCACGCGACTTTGTTCCACACGCAGC
TCGTCATCACCACGCACTCCCCGCACATCCTCTATGAACGCGGATTCTCGCCCATTCGGTACTTCCGCCGCGTCAACGAC
CAGTTGGGCCATCACACGGATGTGCGCAATCTGTCGCTATTCAAAACGGGCGCGTCCGACGCTCCAGCGCGCGAATTCCT
GCAGCGGTATCTGAAGCTGACGCACTGCGATCTCTTTTTTTCCGACGCGGTGATATTGGTGGAAGGCAACGTCGAGCGTC
TGCTCCTGCCTGCAATGATCGAGTTGGTGGCCAAGCGCCTGCGTTCTTCCGCCCTAACCATCCTTGAAGTCGGTGGTGCG
TTCGCGCATCGGTTCCAGGAGCTGATCGCCTTCGTTGGGCTCACAACACTGGTCATCACGGATCTGGACAGCGTGACGGT
CAAGACGGACGCCGAGAAGGCCGCCGCGCAAGGCGCAGGCGCTGAGGGCGCCGTTGACGGAGATGACGAGGACGAGGACG
ACGACCTGAAGCCCTTCGAGCTTGAAGACGACGACGAAGCAGAACCGAGTGGCAAGAAGAAGTCCAAGAAGCGTGGCAGC
ACCTGCCATGCACACGTGGAAGGTGCCGTCACGTCCAACCAAACCCTCATCAGCTGGATCCCGAAGAAGCGGTCGATGGC
AGAGCTCTGGGAAGTCACGGCGGAGCAAAAGACGCTGTCGCTGGCTGAGGATTCCAGCGCTGGGGTTCGGGTAGCTTACC
AGACCAAGGTTTCGGTGACGGTGGGTGCGACGACATCACAGCTCTGCGGCCGCACACTTGAGGAGGCCTTTGGTCTTGAG
AACGCGGACTGGTGCCAGGCTGAGGCAAACCGGTCGGTCGGCCTCAAGCTCAAGCGCGCACCGAGCAGCCCTGAAGAGCT
GGCTGAGAAGTTACACGATAGGGTGGTCGGCAAGAACTTCGACAAGACCCGCTTTGCGCTGGAGGTACTCGCAAGCGGGC
CGCTCAATGGCTGGAAGGTTCCCGCGTACATCGCCGAGGGCTTGGCCTGGCTCGAAGCCAAAGTGGCCCACGAGCTTGAG
GCGGATGCTGCCATCGCCACCGAGGTCGCGACTATTGAGCCGACTACAGCCGATGTTGTCGCTATCATTGTTGACCCGGG
GCAGACGGCATGAGCAGACGAATTGATAGCCCAGATACCGACGCCGACCGCGAGATCCACGCATGCATTGTAGCGACGCC
TCCGCAGCCCTTCGTGGTTCGTGCTGGCGCAGGTTCCGGCAAGACCACCTCCCTCATCAAGGCGCTGGACTGGGTGATCT
CGGAGCACGGCGCCAGCATGCGGGCGAGGAAGCAGATAGTCGCGTGCATCACGTATACCGACCTTGCCACCAATGAAATC
CTGGCGGACGTCAACGATGACCCGCTGGTTCATGTCTCGACCATCCACAGCTTTTACTGGTCTATTGCAAAGACGTTCCA
GGCCGACATCAAGGTTTGGCTGCAGAACGACATCCGCAGGCGGATCTCCGAACTTGAAGAAGAGTTCGAGAATTACAGCT
CGCGTGTCCGGCAGACCACGCGCGACAGGAACAAGGCCGACCAAGAGCGATATGTCCGAAGCCTGGAGGCTGTGGCCGGC
GTCAGGACGTTCAACTACGGCGTGGGCAGTGACTACGCCAAGGGCATACTTGGCCACGAGGACATCCTTCAGCTCGCCGA
CTTCCTGCTACAAAACCGCCCGCTGTTCCGACGGGTCGTGGCGCTGAGCTACCCGTTCGTGTTTATCGATGAGAGTCAGG
ACACGTTCCCGGGTGTAGTGAAGTCTTTCAAGGAAGTGGAAGCCCAGATGCAGGGCAAGTTCTGCCTTGGTTTTTTCGGC
GACCCGATGCAGTCGATCTTCATGAGAGGCGCAGGGGACATCCAGCTTGAGGATCATTGGCGGGCCATCACGAAGCCGGA
GAACTTTCGCTGCGCCAAGCAGATCCTTGACGTCGCCAATGCCGTGCGCGCGCAGGGCGATGGCATGGAGCAAGTCCGCG
GGCTGCACGAGAGGGTCGATGGGAACCTCAAGCTGGTGAGGGGTCGGCCCGGATGTTCGTCTTGCCGAACACGCTGAAC
CGAACCGAGGCTTTGGCAAGAGTCCGAGCGTGGAGCTCGGCGACGAACAACGACGAGGGTTGGACAACCCCAGACATCGC
AGTCAAGATTCTTGTCATCGTGCACCGCATGGCCGCAAACCGGCTTGGCTTCGGCGGCATCTACTCGGCGCTGAACGACA
AGACGTCGGATGCCATGAAGCAAGGGATGCAGGACGGCACCGGTTGGCCCGTTCGACCCTTCCTAAGTTTTGCGCTACCG
ATCGTTGCAGCTGTGAAGGCCGGCAATGAGTTCGCGGCGATGAGCCTGCTCCGGGAATTCAGCCCGCGCCTGGCGCCTGC
GGCTCTGACCGGCCGACGTGCCGCGGATGTATTGCGAGAGCTGCACGCTGCTGCGTCGAGGCTTGTCGCCATGCTGGACG
AGGCAGGGACCACCATTGGTGACATAGCTCTCCATCTCTGTGACACGGGTCTTTTTGAGTTCGACGAGCGCTATGCGCGT
GTTCTTGGGTTTGTCAGGGATATTGCTGACACCGCTCAGGAGCCCGAGGCTGCTGATGCAGTTCCGGCCGAAGGATTATC
CTTGGACGCGACAATGGCCAAGTTCTTCAATTGCTCTGCGCAAGAGCTTTGGCCCTATGAACGCTATGTCTCAGAAGGCT
CCCCCTATGCCACGCAGCACGGCGTGAAGGGAGCGCAGTTCGAACGCGTCATGGTGGTGATGGACGAGGAAGAAAGCGAC
TACCGAACGTACAACTACGAGCGTGTCTTCGCGAGTGCTGAGGCCCGCGCTGCAGATCGTGCACGAGCACTAGACGGTGA
TGAAAACACTTGGAGCCGAACGCTGCGACTGCTTTACGTCTGCTGCACTCGTGCCCAGCGGGGCTGGTACTAGCGTTCT
TTGTCGCCGACCCTGCGACCACCCTGGAAAACGTCGTGGCGAGCGGGATCTTGCCGCGAAGCGCAGTCTTTACGCAGGAA
GTGTTAGTTGGATGGCCATAGACGAACGATTGCCTGACCTATTTGAAGCCAGAGCCGAGCGGCAGGCTCGGTAGCTAGCG
GGTGGTAACTCTGAGGACGTAATCGACTGCAATTGGCCGATTTCTGCCTATGACGAGGGGCAGCTACCGACCCATTGCTA
```

Fig. 2D

```
TCCTTCGTAAGGGTGGCTACGCACCGGGCACGCTGCGGGATCGGCTGAAGCTAAAAAATCGCACAACAGCTTTGTAAAAC
AAGATCTCGGTCGATAACATCTATGAACGGTCTGGGTTGGCAATCAGTATTGGCTGCCAGTTCTTGTGACGATGCATGGT
TTAAATCGACTCTTTGAGGAAATGCGTGGGAAGCCTGGAAAAGTGCTGTTTCGCCTGCAAAGAAATAATTCATGTTCATG
CGATTCGTTGTCGGCAGTGCGGCGAGTCCCAAGGCTGGCGAAGGTTCATGAGCTCTCCAACCTCAGTAGTTGCGTTGGTC
CTTAGCCTTTTATCAATCGCTGCCACAAAACCTGTGGAGCGATTGTTCGATGCCCAGCGAGCAGAGCTACAAATCTCCAT
CACGGGTGGTGATTACAAAGCTGCCCAGCTTATGTTGACCAATAACGGGTCAAAGCCTGCAACTTTAGTTTCCTTCGAAA
TCACATCGAAAGCCACGACCAATACGAAAACATGGTTTTTGGTAAGCAATACGGATGGCGAAATTCTGGAGCCAGGCAAA
ACTTACAAAATCAGGGCCTCAACCGATGAGTCTATCCCAAAAATTGTCGAAGCTGAGCGTCGGACGATTTTGAAGTCTCA
GTACGCACTTGCAGATAATTGCGAATTAACCGCTAAATACATAGAGGCCACGGGGCAGAAGGTTGTGCGTGTGCAACCGT
TCATGTGCGACACACCTCCTGAAAAGGGTGGCCTGCCCCCTGGTAAACCTGGCATACCCATTTGGTACCTTGGTCAAGAA
TGATGTTTTTATGCCGCCCTGGGCTTTGACGCCGATTAAGCAAAGCTGTGTTCGCTCATCCAATACGTCCCTCGCCCAGT
TAAACGACTGTTATGTATATGGGTGCTGCCGCTACGTAATACCTTGGCCCTACGCATACGAAGTTAATTCTGAAAGCGTT
CAATGGACAATCTTCCTCCTCGGCGTCGACTGCAGCGGTAAGGTGATCTACTTTCGAAACACTGCAAGGGTAGGTCCTTT
TTTGGCAGCGTCCATATACCGACCGTGGTATGGCTCAGATGCGCTGGTACTGCATTTCACCAAATAAAGTTGTGCTATAT
CGCTCACGGCCGGTATTTCTATCGTCCAAGGCGACATATTGACGATTTCAAGGGTTACGTACCCGTCGAACCCCGGCTCT
ACCTGACCGTCATTACAGGTTACCTGCACGAACAATCGCGCAAGGGTTCCTTTGGTTTGCACCAGACCAAAATAATCTAA
CGGTATTTTGTATCGATGTTTACTGCAGGTGATGACTTGCTCACCGGATTTCAGCACCAAATTTTGCTGAATTTCTTTTG
GTTCCAAAAAAAACGTCGACGGGGCTGGATGCGACCCATATACAATGCTTGCAGAGGCGGGCAAAGATTTTGGCTCGTAA
TATGTATGCCCCAATTGAATCTTGAGAGAAAACTCGTCAAATAAAGTTTTTTCACATATAGCGCATTGCGCAACAAGATG
TTCTAGATTTTGTCAATGACAATCATTTTGGCTTAACTTCGTTCGGCGATGGCTGAGCGTTTTGTTGTGACTGAGGAGG
CTGCGACTGGTGTTCCAGCACAACCTTGTAATAGACGGCGTACATTATAAGAGAAGACACCAGGGAACTTCCGATTAAAT
TCAGCGTCCACCCGACCCATATGGTGGGATTGAGCGAAAACCACTTCTTCAATCGCGCGCGCCGCGTGATGGGAAGCGTC
GATATTTCACTGCCACGCTTGATGGGCTTTGGGTGTGCGTCGATTCTGTGGAGAAAAAAATCACAGAGCCAAGCTTCTC
GCCTTTGGTAAGGCAGACATTTTTGTTGGTGGTGTTGAATATCCTGAGCTTGAGCTTGCCATCAAATGCAGGTTCGACCT
TCGCCGAAGCAACCAGCACGCCGCGTGAGAGAAAAAGACTTCCCGTAGGTAGGACTATGCCGTACCGATTGTGCGGCACC
TTGATTTCTTCAGCGGCCTCCACCACAACAGAATCGTGACCCTGATCGTCATACCATCGACAATGCGCCACAGGTTTTT
GTCGTTGCCAGAATAGTTATCACTCCACCCTTCACCCACGGACAATTCGAGGGAAAACTCTTCAATTCTCTCGTCCCTG
CATCAGTGAGTATAAGGCTGTTGCTGGAGTACGATGCCGCGTCAAAATCCGTGTGGGATTTCGTTGTACGCCCTTTGATC
TGTAACACACTCATCAGATTTGTCCTTCGTCCTTGGGCTGCGAGACGCGGCCACCCTGCCATTGTCCTTTATACCGGCCG
ATATCCCCGGATACCGCCTGAAAGATGACGTGCGCAAAGCGTGCACCAATCTGAATTTCAAACGCCTCGCTGTGATTGTT
GGTGAGCGCAACGTCATCGGCCCTACATAACCTGGAGGCAGCACACTGGAACTGAACGTTATCCCGCTTCTGAACAGCG
TGCTTCTCGGAAAAAAAAGCGCCGCCAGATCTTCCGGCAGATCGAATTCTTCCATGGTGCTCGCCAGATAAGTCTTGCCC
GGTTCCATGACGAAGCAGTCATCCGGGTCTGCGAGCACGACCTCGCTGGCAGGGGTGCGTCGCGTAGATTCTCGCAAGCT
TCCACCCCCTACTGTCAGGCGAGAGAGGCCTGCGAGTCTGAGGTCAAATCCAACGCCTTCCGGGGTGGTCAACTCACGGT
GGGCAAGGTGCTTGATTAGTTTTCCATCCCGGACCAGTTTCAGGAGCGAGTGCGGTGAGTAAATCATCTATTTTGCCTCG
GGAAGGGCTCAGTCTATAGCACTGAGCAACCGCCTACGTTTACAGGCAAAAAGTCGGACTCAGTCGTTGTGGCCGCATTT
TGCGTGTCCTGCGGGTTTAGTAGCAAGGACAAAACCGTGCGACATGCGCAGCGCACTTTCACTGCACGGACAGCCCCATC
GGCATAGCAAGCCTTCACCGCCACTCTGATTGGGCTCACGTCCGACAAGAGTCGAGCAGCTTTGCAGGATTTTCCACATC
ACCAAAACTGCCAATGGCAGCTAATGGCCGTTCTCTGCCTGTCGCCTCTTTGGCATGACTGGTCAAGTCGGATGCAAACG
GTGGTCAGCACCAATGCAATTGGGTGGTCATGTGCGATGCAATTACGCAGTTGAGCCTGGCCCAGTTCCTCCCAAGCAAA
GCATAAGACCAAGATGGCACATTGCCAACAAAATACCCTTCCCCGCTACCGTTGTTTTATCGTTGTTGCCAGCCCTGATC
TGGCGGAAAAGCCCGCTCCATGAATCGTCATGGAGCCTCCCATGTTTCAACTCCTTTCCTGGATATCCAGGAAGCCGTCC
CCCACCCCAACAACCAAAGCTGCCCCAGGGGGATTCATCCTTCCTCTGAGCAGCATGGAACTGCTCGGCACGCCTCGCCG
CCGGCAGCTACTGGAGAACATCTGGCAGCGCGCCTCGCTATCCAAGCAGCAATTCGAGGAGATCTACCGGCGGCCACTGG
CCAACTATGCCGAGCTGGTCCAGCAGCTCCCTGCTTCGGAAAATCATCACCATGCCCATCCAGGCGGGATGATCGATCAC
GGCCTGGAGATCGTGGCCTACGCACTCAAGGTACGGCAGACCTACCTGCTCCCGATCGGCGCAGCGCCGGAGTCACAGTC
AGCCCAGGCTGAAGCCTGGTCGGCCGCCGCGGCGTATGGCGCCCTGGCTCATGACATAGGCAAGATCGTCGTCGACCTGC
AGGTTGAGCTACAGGACGGCAGCACCTGGCACCCTTGGAACGGACCGATCAACCAGCCATACCGCTTCAAGTACGTGAAG
TCCCGCGAATACCAGCTCCACGGCGCTGCCTCAGCACTTCTCATCCACCAACTGCTACCGCGCACTGCACTCGATTGGCT
CAGTCGCTTTCCAGAGCTGTGGGCTCAATTGATCTACCTGTTCGCTGGGCAGTACGAGCACGCCGGGATCCTCGGCGAGA
```

Fig. 2E

```
TCATCGTGAAGGCAGACCAGGCCTCAGTTGCACAGGAGCTAGGAGGCAATCCGGATCGAGCTCTGGCTGCACCGAAGCAG
TCGCTGCAGCGGCAGTTGGCAGACGGCCTTCGCTTCTTGGTGAAGGACAAGTTCAAGTTGAATCAACCTAGCGGCCCGTC
TGATGGATGGCTGACCCAGGACGCACTCTGGCTGGTGAGCAAGCCTGCTGCCGATCAACTGAGAGCCTACCTGCTGGCCC
AGGGTATCGATGGGGTGCCCTCCTCTAACGCGCCGTTCTTCAGCATGCTCCAGGACCAAGCCGTCATCCAGACAAATGCC
GAGGACAAGGCCATTTGGACGGCCACGGTAGACAACGGTGCTGGATGGAGAAACAAGTTCACGCTACTCAAGATTGCTCC
AGCCTTGATCTGGACAGATGCTGCCGAGCGCCCCTCACCCTACAGCGGATCACTGGTCGTTGAAGATGGAACCGCCTCAA
CGGAAAAGCCGGAAACGACCTGTGAAATTCCCAACGGGCCGGCTGAACAGCAGCAAGCACCAGAAACGAAGATGATGCTC
CATCAACCTGCGCCGAGCGTTGCGAAACCGGCAAACGAGACGCAGGCGATTGCGAAACCCTCAACTGATGATCAAGAAGA
AACAGACGATTTGTATGCACTTCTTGGTAATATCAATTCGCCACTAGAAGAGCTAGACACTAGCCACGACTCGCCGGCTG
CCTCTCCTACGAACACACGCGGGGAGGAGAACCTACAGCAGCCACTAGGGACCAAGGAGCCAACAGATTGCGCTCCTGAA
GCAATTGAAGATGTATTTATGCCTAGCAGAAGTACTGATCTGGGACAGGGATTCGTTGGTTGGATGAAATCTGGCATCGC
GGCCCGTCGCCTGTTCATCAACGACACCAAGGCTTTGGTGCATACCGTAGACGGGACCGCCATGCTGGTCACGCCAGGAA
TTTTCAAGCGCTATGTCCAAGAGCATCCGGTGCTTGAAAAACTGGCCCAAGCCAAGGAGACGACCGGCTGGAAGCTGGTG
CAGCGCGCGTTCGAAAAACAGGGGCTTCATCGGAAGACCAGTAAAAACCTGAACATCTGGACCATCAAGGTTTCTGGTCC
TCGCAAGACGAAAGAGCTCAAGGCCTACCTGCTCCAGGATCCCAAATTGCTGTTCCCTGAGCAGCCTCTGGACAACCCAA
GCCTCACGGTCATCACCGATGCCGAAGGAGGTGTGGAATGACGCCGCAGCAGCTCACCGAGGAGTACATCTTCGCGCACG
ATCTCCGGGAAGCCAGCGCGAAGATCTACCGCGCCGCGACCAAGGCGCTGCTCAAGCACTTCGGTCCTACGGCAACCGTA
CAGGACGTGGACCACCGGGCTGTCCTGGGATGGCGACGCAAGGTACTGGAACAAGGCCTGTCCAAGCGGAGCTGGAACAC
GTACTCGAATCATCTGCGGACGATCTGGGGCTATGCCATCGAGCATGAGTTGGTGACGCACTCCCAAGTCAACCCGTTCA
GAAAGACCACCGTCATTCCCCCAGGCGAGCAAGCAAAACCGTCGCCGCCGAAGCCATCCTGCTCGCCCGCAATTGGCTC
AACATGCAGGACGGCGCAGAGCGCTGCACCGGCGAACGCGCACGGATCACGCCCGCCTGGTTCTGGCTTTGCACGTTTGA
GGTCTTCTACTTCACCGGCATCCGGTTGAATGCGCTGTTGTGCATCCGCAAGCGCGACATCGACTGGGAAAATCAACTGA
TCCTCATCCGCGGCGAGACAGAGAAGACTCACAAAGAGTTCGTAGTGCCAATAACGGAGGGGCTTGTGCCTCACCTATCG
AGGCTCCTGCAAGAGGCCGATAGAGCCGGATTCGCCGATGACGACCAGTTGTTCAACGTCAACCGGTTCTCACCGCACTA
CAAGAGCAAGGTGATGAACTCCGACCAGGTCGAAGCCATGTACCGGAAGTTGACCGAGAAGGTTGGGGTGCGGATGACCC
CGCACCGTTTCCGGCACACCCTGGCCACCGACTTGATGAAGGCACCCGAGCGGAACATTCACCTCACGAAGTGCCTGCTC
AACCACTCGAATATCCAGACCACGATGAGCTACATCGAGGCCGACTACGATCACATGCGTGCCGTGCTGCATGCTAGAAG
CCTGGCCCAAGGCGCGCTGGAGAATGTCAGGAAGGTGGATTACAGCGGCTCCCCGCAAGCCTCTGCCAAACCGAAGCCAT
GCGGGCAACCTCTCGCTCGAGTGAGTGAAGCGCCGCCACCGGAGGCCAGGACAGAGCCTGCAGAACCAAGGGAGCACACG
CCAGGGACAGGCATTCAGGGAGGTCCAACCGCGTGGGAAGCAGATGCGCTACCACAGCCACCTGACACCTTCGAACCAAG
CGTGCTGTTCACTCTGATGGCTCAAAACTTATCGAACCGTGCCGCCTCGGCATCCGCGGCTCCCGCTGCAACAAGCGGAT
CAGGCGGATGGGGATCTGCCGCCCGAAGCAATCTCGCCTAGCGATACCGGTACTGAGGGCCGGCTACCGGACGAAAGGTA
GCCGTGCCTTCCAGCAGATCGTTAGGCCTGTAGGAAAAATCTGGAATTACCGAGAGCGCCTGGATTCCAGCGCCGGCATG
CTGGCAGAGCCAGCGCAATTTCAAGGCCAATACCACAGTACCCTCTGTAATCGCTGATTACGTCGGGGGCGCATTGCTAC
GCCTGCAGAATGGTTTCAGGGCCTTAGAAACAGAAAAGCCCACCTAGAAAGGCGGGCTATTCCATATTGACATCACGTCA
ATGCGGGCCTAATGTTCGGCCCAGACGGCTGCTAGACAAGAACCGGCGTAACACCCCTTCCTAGCCTATGCAACTCGCCC
CGTAGAAAATGGTGGGTCGTGTAGGATTCGAACCTACGACCAATTGGTTAAAAGCCAACTGCTCTACCGACTGAGCTAAC
GACCCAAGTATGAGGTGGTCGGGGTAGAGAGATTCGAACTCCCGACATCCTGCTCCCAAAGCAGGCGCGCTACCGGACTG
CGCTATACCCCGATTGGAATTTGGCTCCGCGACCTGGACTCGAACCAGGGACCCAATGATTAACAGTCATTTGCTCTACC
GACTGAGCTATCGCGGAACGTCTTTCTTCCAACCCTGGACGCTTCCGGTGTTGCTGGATTCGCGTCTCAGAGGCGCGCCA
TTTTACGGATGCGCGCGGGCATGTCAACCCTCTGATCCAAAAAGTTTTTCTTCTTTTTCCACGAGCGACAAAACGGCCCT
TCCACTGCATGCGGCAGCGCTCTCGCGCCTACCGGACGCCCATGAAAAAGCCCCGCCGAAGCGGGGCTTTCCCTGTCCGC
CCCCGAAGAGGTCAGGCGAAGACGATCTCGTCGCCTTCCACCTTCGCCGAGATACTGGCACCCGGCGCGAATTTGCCGGC
CAGGATCAGTTGCGCCAGCGGGTTCTCGATCCAGCGCTGGATGGCCCGCTTCAGCGGGCGTGCGCCATAGACCGGGTCGA
AGCCGACGGCAATCAGCTTGTCCAGCGCCTCCTGGCTCAGTTCCAGGCTCAGCTCGCGCTCGGCCAGGCGCTTGCGCAGG
CGACCGAGCTGGATCTCGGCGATGCCGGCGATCTGCTCGCGAGCCAGCGGCTCGAACACCACCACTTCGTCGATCCGGTT
```

Fig. 2F

```
GATGAATTCCGGACGGAAGTGCGCATTGACCGCGTCCATCACTGCGGCACGTTGCGCCTCGCGGTCGCCGGCCAGCTCCT
GGATCTGCGCCGAACCGAGGTTGGAGGTCATCACCACCACGGTGTTGCGGAAGTCCACCGTACGCCCGTGACTGTCGGTC
AGGCGTCCGTCCTCGAGCACCTGGAGGAGAATGTTGAATACATCCGGATGGGCCTTCTCCACCTCGTCCAGCAGCACCAC
CGAGTAGGGCTTGCGGCGGATCGCCTCGGTCAGGTAGCCGCCTTCCTCGAAGCCGACGTAGCCCGGAGGCGCGCCGATCA
GGCGGGCCACCGAGTGTTTCTCCATGAACTCGGACATATCTATCCGCACCAGCGCCTCCTCGGTATCGAAGAGGAACTCG
GCCAGCGCCTTGCACAACTCGGTCTTGCCCACCCCGGTCGGGCCGAGGAAGAGGAACGAGCCGCTCGGCCGGTTCGGATC
GGCGAGGCCGGCGCGCGAACGGCGCACGGCGTTGGACACGGCGACTACCGCCTCGTCCTGGCCGATCACTCGCCGATGCA
GCTCCTGCTCCATGCGCAGCAGCTTCTCGCGCTCGCCCTCGAGCATCTTCGACACCGGGATACCGGTCCACTTGGAAACC
ACTTCGGCGATTTCCTCGTCGGTCACCTTGTTGCGCAGCAACTGGTTCTCGGTCTTGCCGTGCTGGTCGACCATCTGCAG
GCTGCGTTCCAGGTCCGGGATGGTCTGGTACTGGATGCGCGCCATGCTCTCGAGGTCGCCCTTGCGCCGCGCCGCCTCCA
TCTCCTGCTTGGCCTGCTCGATCTTCTGCTGGATCTGCGCCGAGCCCTGCACCTCGGCCTTCTCGGACTTCCAGATCTCC
TCGAGGTCGGCGTATTCGCGCTCGAGCTTGACGATATCCTCCTCCAGCTTGGCCAGGCGCTTCCTGGTGGCTTCGTCGTC
TTCCTTCTTCAGCGCCTCGCGCTCGATCTTCAGCTGGATCAGGCGACGGTCGAGACGATCCAGTTCCTCCGGCTTGGAGT
CGATCTCCATGCGGATGCGGCTGGCGGCCTCGTCGATCAGGTCGATGGCCTTGTCCGGCAGTTGCCGATCGGTGATGTAG
CGGTGCGACAGCTTGGCCGCGGCGATGATCGCGCCGTCGGTGATGCTCACCCCGTGGTGCACTTCATAGCGTTCCTTGAG
GCCACGGAGGATGGCGATGGTGTCTTCCTCGCTCGGTTCGTCCACCAGCACCTTCTGGAAGCGGCGCTCCAGCGCGGCAT
CCTTCTCGATGTACTGGCGATACTCGTCGAGGGTAGTAGCACCGACGCAGTGCAGCTCGCCGCGCGCCAGAGCCGGCTTG
AGCATGTTGCCGGCGTCCATGGCACCTTCCGCCTTGCCGGCGCCGACCATGGTGTGCAGTTCGTCGATGAACAGGATGAC
CCGGCCTTCCTGCTTGCCCAGTTCGTTGAGGACCGCCTTCAGGCGTTCCTCGAACTCGCCGCGGAACTTGGCACCGGCGA
TCAGCGCCCCCATGTCCAGGGCCAGCAGGCGCTTGTCCTTGAGGCCGTCCGGCACTTCGCCGTTGATGATGCGCTGGGCC
AGGCCCTCGACGATGGCGGTCTTGCCGACGCCGGGTTCGCCGATCAGCACCGGGTTGTTCTTGGTCCGCCGCTGCAGGAC
CTGGATGGTCCGGCGGATCTCGTCGTCGCGACCGATCACCGGGTCGAGCTTGCCTTCCTCGGCGCGCTTGGTCATGTCGA
CGGTGTACTTGTCCAGCGCCTGGCGCGACTCCTCGACGTTCGGGTCGTTCACCGCTTCGCCGCCACGCAGGTTGGCCACG
GCATTCTCCAGCGCCTTGCGCGACACGCCCTGGCCGAGCAGCAGCTTGCCGAGCCTGGTGTTCTCGTCCATCGCGGCCAG
CAATACCAGCTCGCTGGAGATGAACTGGTCGCCCTTCTGCTGGGCCAGGCGGTCAGCCTGGTTGAGCAGGCGTGCGAGAT
CCTGGGACAGGTTCACGTCGCCGGTCGGGCTCTGGATCTTCGGCAGCGCGTCGAGTTCTTTGTTGAGGCCGCTGCGCAGG
GCGGCGATATCGAAGCCGACCTGCATCAGCAGGGGCTTGATCGAACCGCCTTGCTGCTCGAGCAGGGCGGAAAGCAGGTG
CACCGGCTCGATGGCCGGATGGTCATGGCCAACGGCCAGGGACTGGGCGTCGGAGAGCGCCAGTTGCAGCTTGCTGGTCA
AACGGTCTATTCGCATGGGTCGTCCTTCCTTCTATAGAGCGGGCCGGAACGATGGGTGTCCCTGATGAAGAAAAGCCCGC
CGAGATGACTCAGTAGATAAGGGCGATTTTCCGCGGTTCAAGCGACCGGACCGTGACATCGGTCAGTTGCCGCCGGATAA
CCTGCGCGGGCCTAGTCCTGGAGCCAGACCAGGCTGGCAAAACGGCCGGTACGCGACGAGCGGCGGTAGGAATAGAAGCG
CGCGGTATCGCTGAAGGTGCAGAAGCCGCCGCCATGCACGGCGGTGACGCCATGGGCGCCCAGGCGGATCCGCGCGAGTC
GGTAGATGTCGGCCATGAAGCGGCCCGGATTGGCGCTAGGTACGAAAGCCGAGCGCGCCTCGGCGTGCGCAGCGACGAAT
GCATCGCGGACCTCGCCGCCGACCTCGAAGGCCTGCGGGCCGATCGCCGGCCCCAGCCAGACCAGCAGTTCGTCGCCGGG
CACGCCCAGGCTGTCCACCGTCGCCTCCAGCACGCCCGCCGCCAGCCCGCGCCAGCCGGCATGGGCCGCGGCCACCCGGG
TGCCCGAGCGGTCGCAGAACAACGCCGGCAGGCAGTCGGCGGTCATGATCGTACAGGCGACGCCCGGCATCGCGCTCCAG
CTGGCGTCGGCCCTGAGCACCGGTTCGGGTCGGCCTCCACCACGTCACTCCGTGCACCTATTCCAACCAGCTCGGCCGGC
ATTCCAGACGCTCGGTCAGGCGTCGGCGGTTTTATTCCACGGCGCGCGGATCGTCGTAGACGTGGGCGCCAAGGTTCAGA
CTGTCGAAGGGTGCCTGGCTGACCCCGCCACTGCGCGTGGTCACGCAGGCCCGCACACGGGCCGGCGCCGGCCAGTCGGG
GGTCAGCCAGGCGTTCAACCGACGAACGCCTCGCGATCCTGGCGCAACAGGCTGAGCAGCCAGAGGAATTCTTCCGGCAG
CGGCGATTCCCACTTCATGCGCACGCCGGTGGCCGGGTGATCCAGTTCGAGGAAGCGCGCGTGCAGCGCCTGCCGGGGA
ATTCGCGAAGAGTCTGGACCAGGGTCTGGCTGGCCACCGGGGGAATCCTGAAGCGCCCACCGTAGACCGGATCGCCGACC
AGGGGATAGCCAATATGGCTCATGTGCACGCGGATCTGGTGGGTACGCCCGGTCTCCAGCTTGACCCGGGTATGGGTGTG
CGCACGGAAGCGTTCCAGCACGCGGTAATGGCTGACCGCCACCTTGCCGGCGTCGACCACCGCCATCTTCTGCCGCTGCA
CGCCATGCCGTCCGATCGGCGCATCGATGGTGCCGCCGGAGGTGATCACGCCGATCACGATCGCCTCGTAGATGCGGCTG
ACCGACCGTGCCTGCAGTTGCGCCACCAGCTTGGTGTGGGCCTCCAGCGTCTTGGCCACTACCATCAGGCCGGTCGTGTC
CTTGTCCAGGCGGTGGACGATCCCGGCGCGCGGCACATTGGCGATGTCCGGGACATGGTAGAGCAAGGCATTCAGCAGGG
TGCCGTCCTGATGGCCGGCAGCCGGATGGACCACCAGGCCGGCGGGCTTGTCAATCACCAGGATGTGCTCGTCCTCGTAG
ACGATTTCCAGCTCGATGTCCTGTGCGAGCCACTCGCCCTGGGCTTCCTGCTCGGCCTCCAGGACCAGTTGCGCGCCGCT
```

Fig. 2G

```
GTGGACGATGTCGCGCGGGCGCAGCACGGCGCCGTCGACGGTCAGGCGACCGTCCTTGATCCAGCCGGCCAGACGGGAGC
GGGAGTGTTCGGGAAAAAGCTGGGCGGCGATCTGGTCGAGACGCTGGCCACCCAGCTCGAACGGCACCTCGGCCGCGCGT
TGAATCATATCGGACATGAGTAGGAGACGATGCTCAGCGCGGCTTTTGGAATCGGCTACGCGCTGTGGTTAAATACGGGG
TCTTTGTCCCAGGGGGTGCCTGGGGCGCCAATCATAACAGACGGTTGAGGCCAAGCCGACCGTCCCAGGGACGCAAGCCG
CCATGCAAGTGAAACACCTGCTGCTGATCGCCATCCTCGCCCTCACCGCAGCCTGCTCCTCGAACAAGGAGACTGTCGAC
GAGAACCTGAGCGAGAGCCAGCTGTACCAGCAGGCGCAGGACGACCTCAACAACAAGAGCTACAACAGCGCCGTCACCAA
GCTGAAAGCCCTCGAATCGCGCTATCCCTTCGGCCGCTACGCCGAGCAGGCCCAGCTCGAGCTGATCTACGCCAACTACA
AGAACATGGAGCCCGAAGCCGCCCGCGCCGCCGCCGAACGCTTCATCCGCCTGCATCCGCAGCACCCCAACGTCGACTAC
GCCTACTACCTCAAAGGCCTGTCCTCCTTCGACCAGGACCGCGGCCTGCTGGCGCGCTTCCTGCCGCTGGACATGACCAA
GCGCGACCCGGGCGCCGCCCGCGACTCCTTCAACGAGTTCGCCCAGCTCACCAGCCGCTTCCCCAACAGCCGCTACGCCC
CGGACGCCAAGGCGCGCATGGTGTACCTGCGCAACCTGCTGGCGGCCTACGAAGTGCACGTCGGCCACTACTACCTGAAG
CGCCAGGCCTATGTCGCCGCCGCCAACCGCGGTCGCTACGTGGTGGAGAACTTCCAGGAAACCCCGGCCGTCGGCGATGG
CCTGGCGATCATGGTCGAAGCCTACCGTCGCCTGGGTCTCGACGACCTGGCCAGCACCAGCCTGGAAACCCTCAAGCTGA
ACTATCCGGATAACGCCAGCCTCAAGGATGGCGAGTTCGTCGCCCGCGAAAGCGAGGCCGACACCCGCTCCTGGCTGGCC
AAGGCCACCCTGGGCCTGATCGAAGGCGGCGAGCCGCCGCCGCACATGGAAACCCAGGCCGCCAAGGACGTGATCAAGCA
GTACGAGGATGCCGAGCGGGAGATCCCCGCCGAACTGAAGCCGGAAAACCAGGATCACAGCGCCGACGACGAGAAGCCGG
AGAGCGATGACGACGAGGACTCCGGTCGCTCCTGGTGGAGCTACATGACCTTCGGTCTCTTCGACTGATCGCACGAAACA
CCGAAGGGAGGCGCAGGCCTCCCTTCTTTTTGCCCGCCGCCATGCCTCTCCCAGCGCCAAACGCCGCACAGCCTGGACCT
TCCCGTCTGGGATCGAGCCGGCGGCTTGGCTAAACTGCAGCTTTCTCCAGCCTCCGAGATCACCATGGGCCTTTTCCGCC
TCCTGTTCTGGATCGCCCTGATCGCCATCGCGTTCTGGCTCTGGCGTCGCTTTACCCGTCCCACTCCGCGCCAGCAGCAA
CGTCCGCAGGACGAGCCGAGCGCATCGCCGATGGTCCGCTGCGCCCATTGCGGCGTCCACGTGCCGCAGGCCAACGCCCT
CGCCCACGAACAACGCTGGTATTGCAGCCAGGCGCACCTGCGCCAGGACCAGGGCGACCGTGCGCGCTGAACGGCTACGG
CTGAGCGAGGAGCAGGGGCAACGCATCCTCCGTCTGTACCACCTGTACGCCTGACCATCGGCCTGGTACTGGTCCTGCT
GATCTCCAGCGAACTGGAAGATCAGGTCCTCAAGCTCGTCCACCCTGAACTGTTCCATGTCGGCAGTTGGTGCTACCTGG
TCTTCAACATCCTGGTCGCGCTGTTCCTGCCGCCGTCGCGGCAATTGCTGCCGATCTTCATCCTCGCGCTCACCGACGTG
CTGATGCTTTGCGGCCTGTTCTACGCAGGTGGCGGCGTACCAGCGGCATCGGCAGCCTGCTGGTGGTGGCGGTGGCCAT
TGCCAACATCCTGCTGCGCGGGCGCATCGGCCTGGTCATCGCGGCGGCGGCCAGCCTCGGCCTGCTCTACCTGACCTTCT
TCCTCAGCCTGAGCAGTCCGGACGCCACCAACCACTACGTCCAGGCCGGCGGCCTCGGCACCCTGTGCTTCGCCGCCGCG
CTGGTGATCCAGGCTCTGGTGCGGCGCCAGGAGCAGACCGAAACGCTGGCCGAAGAACGCGCCGAGACGGTCGCCAACCT
GGAGGAACTCAACGCATTGATCCTGCAGCGCATGCGCACCGGCATCCTCGTGGTCGATAGCCGTCAGGCCATCCTCCTCG
CCAACCAGGCCGCCCTCGGCCTGCTCAGGCAGGACGACGTGCAGGGCGCCAGCCTCGGCCGCCACAGCCCGATGCTGATG
CACTGCATGAAGCAATGGCGCCTGAATCCCAGCCTCCGTCCGCCGACGCTCAAGGTGGTGCCGGATGGCCCGACGGTGCA
ACCCAGCTTTATCAGCCTCAACCGCGAAGACGACCAGCACGTGCTGATCTTCCTCGAAGACATTTCGCAGATCGCCCAGC
AGGCGCAGCAGATGAAGCTGGCCGGTCTTGGCCGCCTGACCGCCGGCATCGCCCATGAGATCCGCAACCCGCTGGGCGCG
ATCAGCCACGCCGCCCAACTGCTGCAGGAGTCAGAGGAACTGGATGCCCCGGACCGACGCCTGACGCAGATCATCCAGGA
CCAGTCGAAGCGGATGAACCTGGTCATCGAGAACGTCCTGCAGCTCTCCCGTCGCCGCCAGGCCGAACCGCAGCAGCTCG
ACCTGAAGGAGTGGCTTCAGCGGTTCGTCGACGAATACCCCGGCAGGCTGCGCAACGACAGCCAACTGCACCTGCAGCTC
GGTGCCGGCGACATCCAGACCCGCATGGACCCACACCAGTTGAACCAGGTGCTGAGCAACCTGGTGCAGAACGGTCTTCG
CTACAGCGCCCAGGCGCACGGGCGCGGCCAGGTCTGGCTGAGCCTCGCGCGCGACCCGGAGAGCGACCTGCCGGTGCTGG
AAGTCATCGACGACGGTCCCGGCGTACCGGCGGACAAACTGAACAACCTGTTCGAACCCTTCTTTACTACAGAAAGCAAA
GGCACCGGCCTGGGCCTCTATCTCTCCCGCGAACTCTGCGAGAGCAACCAGGCACGGATCGACTACCGCAATCGCGAGGA
AGGCGGCGGCTGCTTCCGCATCACCTTCGCCCACCCGCGCAAACTCAGCTGACGGAAGCCGCACGCATGAGCCGACAAAA
AGCCCTGATCGTCGACGATGAACCGGATATCCGCGAACTGCTGGAAATCACTCTCGGCCGCATGAAGCTGGACACCCGCA
GCGCCCGCAACGTCAAGGAAGCCGCGAGTTGCTGGCCCGCGAGCCGTTCGACCTGTGCCTCACCGACATGCGCCTGCCGG
ACGGCAGCGGCCTCGATCTGGTCCAGTACATCCAGCAGCGCCATCCACAGACCCCGGTGGCCATGATCACCGCGTACGGC
AGCCTGGACACCGCGATCCAGGCGCTCAAGGCCGGTGCCTTCGACTTCCTCACCAAACCGGTCGACCTCGGTCGCTTGCG
GGAGCTGGTGGCAACCGCCCTACGCTTGCGCAACCCGGAAGCCGAGGAAGCGCCGGTGGACAACCGCCTGCTCGGCGAGT
CGCCGCCGATGCGCGCCCTGCGCAACCAGATCGGCAAGCTGGCGCGCAGCCAGGCGCCGGTCTACATCAGTGGCGAGTCC
GGCAGCGGCAAGGAACTGGTGGCGCGCCTGATCCACGAGCAGGGCCACGTATCGAGCGGCCGTTCGTGCCGGTGAACTG
CGGCGCGATTCCCTCCGAGCTGATGGAAAGCGAGTTCTTCGGCCACAAGAAAGGCAGCTTCACTGGCGCTATCGAAGACA
```

Fig. 2H

```
AGCAGGGCCTGTTCCAGGCCGCCAGCGGTGGCACCCTGTTCCTCGACGAAGTCGCCGACCTGCCGATGGCCATGCAGGTC
AAACTGCTCCGGGCGATCCAGGAAAAGGCCGTGCGCGCGGTCGGCGGCCAGCAGGAGGTCGCCGTCGCACGTGCGCATCC
TCTGCGCCACCCACAAGGACCTCGCCGCCGAAGTCGGCGCCGGGCGCTTCCGCCAGGACCTCTACTACCGCCTCAACGTC
ATCGAGCTGCGCGTACACCGCTGCGCGAACGCCGCGAGGACATCCCGCTGCTCGCCGAACGCATCCTCAAGCGCCTGGCC
GGCGACACCGGCCTGCCGGCCGCCAGGCTGACCGGCGACGCACAGGAGAAGCTGAAGAACTACCGCTTCCCGGGCAACGT
CCGCGAGCTGGAAAACATGCTGGAGCGCGCCTATACCCTGTGCGAAGACGACCAGATCCAGCCTCACGACCTGCGCCTGG
CCGATGCGCCGGGTGCCAGCCAGGAAGGCGCCGCGAGCCTGAGCGAAATCGACAACCTCGAGGACTACCTGGAAGACATC
GAGCGCAAGCTGATCATGCAGGCACTCGAGGAGACCCGCTGGAACCGCACCGCCGCGGCCCAGCGCCTGGGCCTGACGTT
CCGCTCGATGCGCTACCGCCTGAAAAAGCTGGGCATCGACTGAAAGTGAAAAGGCCTGTCCGAAGACAGGCCTTTTGGTT
TTCGCTCCTCAGAGGCGACCAGCCGGGGCGTAGGGGCCGGGTCGATGATCGGTTCCCGCCCGCTCATGAGATCCGCCAG
CAGACGGCACGACGCCGGTGCCAGGACCAGCCCGTTGCGGTAGTGCCCGGTATTCAGCCAGAGCCCGTCGAAGCCAGGCA
CCGGACCGATATAGGGGATGCCTTCGGGAGAGCCCGGGCGCAACCCTGCCCAGTGGGCCACCGGCTGCATGTCCGCCAGT
TCCGGCAACAGTTCTGCCGCAGACGCCCTGAGGCTTTCCAGCGCCTCGTCGGTCGGCGTCTTGTCGAAGCCCGAATGTTC
CAAGGTGCTGCCGATCAGGATGTGGCCGTCGCGCCGCGGAATCGCGTAGCGCCCCTTGGCCAGCACCATGCGCGGCAGGA
AATCCGCCGCGCACTTGTAGAGGATCATCTGACCTTTCACCGGTACCACGGGCAGTTCCAGGCCAAGCGGCTTCAACAAC
TCGCCGCTCCAGGCGCCTGCCGCCAGCAGCACCTTGTCGCCACGGATCTCGCCACGCGAGGTCGCCACGCCGACCACTCG
ATCGCCGTCGCGCAACCAGCCGCGCACCTCCGTCTGTTCATGCAACTCGAGATTGGCGAATTGTTGCAGGGATGCCCGCA
ATGAGCGCGCCAGGCGAGGATTGCGCACATTGGCCACGCCCGACATGTAGACCGCCCGCTGGAAGCCTGCGCCCAGCCCG
GGCACCGCCGCGTAGGCCTCCTCGATCGGCACTTCCTTCAACGGCCGGGTGTGGTTGCGTGCCCACTGCAGTGCCTCGGT
CTGGTCGTCCAGGTCCAGCCAGTACAGGCCAACGGTATGGACCTCGGGATCGAGCCCGGTCTCGTCGAGCAAACGCTGCC
CCAGGGCCGGGTAGAAGTCCTGCGACCAGTGCGCCAGGGCGGTCACCGCCGGGCTGTAGCGCCACGGATAGAGCGGCGAG
ACGATCCCGCCTCCCGCCCAGGATGCCTCACGCCCACTCTCGCCCCGCTCCACCAGGGTCACCCGCAGTCCGGCGAGCGC
CAGCTCCCGGGCGGTCAACAGGCCGATGACGCCAGCGCCTACCACTACTACATCTCTACTCACCACAGGGCTCCTACCGA
TTTGCCAGGAACAGAGAAATATCACTCAAAGGGATCAGATGCTGACGAATTGCCTGCTTCAACGAACTCAGTCGAATCTA
GTCCCGGTGAAAAGCCCATCATACCCGCAGAGGTATTCATCCCATGAAATCGAGTGGTTTGAATTTGGTGGAACTATCGA
TAGTCCTATCGATCCTTGCGATAGGCGTGACAATTGCGCTGCCCACCCTCCCCGACAGAATGAAGCGGGACATTAGCCGT
GATATTGGTGACAGCCTGACTAGTCATGTGATGGCTGCGCGGGCTAGCAGCATACAGAACGGCGTGATCATCGAGGTGTG
CGGTAGCGGTGACGGCAGTACCTGCAGCGAGGAATGGCATCTCGGCTGGTTCAGCCGTAACGACAGGAGCCAACAGATAC
TGGCCCGGCATGAAAATACGAGTCGCACCGATATTCATTGGCGGGCTTCGACAAGCGACTGCGCTACCTGCCTAATGGC
ACCAGCCCTACAGGTAACGGGCGTTTCTTCGAATGTAAGGACGATCGCATCGAGTGGCAATTGGTGCTCAATCGGCAAGG
CCGCCTCAGGGTGGCGGGAAAGAGCGAAAATAAAAAGCTCTCTTACCTGTGCTCCAGGCGGTGAGAGAACTGTTTCACAT
ACCGTTTGCCAGTCATCCCACTCTCCGCTCCGGCTGTCTCTGCTACAGGGACAATGCGCTCTCCACTAGGCAAGATTATC
TGGCCCTTTTCCTTGTGGAGTACTGCATGCGCTCTATTTGTCGCAGCGCCGGCTTTTCCCTGATCGAGTTGATGATGGTG
TTGGTTCTGGTCGCCATATTCGCCAGCATTGCCGTACCCAGTTTCAACGCCTTGATCGAGCGCAACCGAATCCAGACTGC
CAGCGAGGAACTCTACAGCCTGCTTCAGTACGCTCGCAGCGAAGCTGTAAACCGTCATGCCAATGTGAGCATCAGGGCGA
CGCAGAACAATGACTGGGCAAAAGGCCTGGAAATCATCAGCGGCGCGACCACCGTGCAAAAGCACCAAGGTTTCCAGCAG
GTCTCGCTATCCGCCAGCAGTGCGACTGCGGAGCTGACCTTCAACGCTACCGGCACACTTAGCAACCAGGCTGCAAACAT
TGACATAAAGGTCTGCTTCGCCGGTGACAAAAGTACAGGACGTCTGCTTACCGTTCAGCCCAGTGGACGCGTGATCCTGT
ACCCATCTTCAAAGCAACCGGACAGCTGTAACTGAGGAAAGCCCATGTCTCGAGAAACGGGTTTCAGCATGATCGAAGTA
CTGGTTGCTCTGGTGCTGATCAGCATTGGCGTACTGGGCATGGTTGCCATGCAAGGGCGCACGATCCAGTACACGCAGGA
GTCGGTACAACGCAATGCCGCAGCAATGCTTGCTAGCGACCTGATGGAAATAATGCGTGCGGACCCAGATGCCGTACTCA
ATCTACGCGCCCAACTACGCGAAGACTCGGTCTACTACAAGGCCAAGGGCAGCGACTTTCCCGCAGCCCCAGCGCGCTGC
GCGCCATTGCCAGCAGATGCTAAGGAACGTCTCGGCTGCTGGGCCCAACAGGCCTCGAAAGACTTGCCGGGAGCCTCCGC
ACTCTTGAATAGCCAATTCTACATTTGTCGCAGCCCAACCCCGGGTACCTGCGACAACACCAAAGGCTCGGCCATCGAAA
TCCAGGTTGCCTGGCGAGCCATGGATGGAGCGTGTTTCAACGCCTCTGACTCCACCTTGTGCACCTACAGCGTCCGCTCC
GAATTGTGAGAACAAGCATGCTCTTCAGCAAAATGCAGAAAGGCCTATCGATGGTAGAACTGCTCGTGGCACTCGCTATA
AGCAGCTTCCTGATCCTGGGGATCAGCCAGATCTACATCGACAACAAACGCAACTATCTTTTCCAGCAAGGCCAGGCCGG
CAACCAGGAAAATAGCCGCTTCGTTCTTATGCTGCTGCAGCAACAACTGGATAAGACAGCCTATCGTCGCCTTCACGACG
ACAACATGGAGAATGCTTTCAAATCCGCGACATTCAATGGCTGTCGTGCATTTGTGGCTGGCGAGACTATCGCTGCGGCA
ACTGCCCTCAAGGCGGGTGAGTACGGTGTCTGCTTGCGCTATCAACCCGCCTACAAAGGGGAGCATGATTGCCTCGGTAA
```

Fig. 2I

```
TGAAATTACCGGAGTTCCGGAAAAGCCCTTCACAAATACTCCCCCTGTCGTCGTTCGCCTGGTCTACCTACCGAGCGCCG
GTACCCTGAGTTGCAGTCGTCCCGATATCGCCCAGTCGAAATCGGGAGAATTGGTCAGTGGTCTCACAGACTTCCGCTTG
GAAGCGGGGGTCGGGCCAGCAGATCGTAGCGAACGCAAAGTATCCAGCTTCGTCGCACTACAGGATGTCGCCGGTCGTCC
TATCCGAGCATTGCGCTTCTCAATCCTGGCAGGCAGCGACAATACAAGCCTGCGCACAGGAGATGATAGCCAGGCACGCG
ATCGCTGGATCGTCCTTTATCCCGAGAGCAAAAGCGCCATCGAGGCCGCAGACAAAGGCCAGATTTACCAAATAGCGCGT
GGTAACCAAACCATCAGGAATCTCATGCCATGACCCTGCGCCATACCTCTCGACAGCAGGGATCCACGTTGTTGATCTCG
CTGGTTATCTTGTTGATGATCACGCTCCTCGCCGTTTCCAACATGCGCGAGGTGTCACTGGAAAGCCGTATCACCGGCAA
TCTCATCGAACAGAAGCGCCTGCGCAATGCGGGCGAAGCTGGGCTACGCGAAGGTGAACGACGCTTTTTCAATACCATCA
AGCCCCCAGAGGTCGGCAGCGGATGCGCCGATAGCAATGTCAAACGGCCTTGCATACTGAACCTGAGTGCCCTCTCCGTA
CCCCGAGATGACGTGCACAACAATCCGGTGGCAGCCCTGAACGGCAAGACAGATAACGCCAATTCACGTGTCTGGATGCC
CTACCGAGGCAGCGATCTGAATAACCCTACGCAGATCGACAAAGACCGCGCAGTCACCTGGCAGACCATCACGGTGCCCG
CTGGCGAACAGAACAACGAAGCGGAAAATCCCGAGTACGGCAACATGATGCGCGGGGTCGGCACGTTCTACTACGAAACC
AACAGCCGCGCCCTCAACAAGGCGGGCGGAGAGACTGTTCTACAGGCCGTTCATGCACGCCTGTATACCAACTGACTGGA
GCCAGCGCATGATCCACCAGATTACCCGCGCAGGAAAAAGCCTGCTGGCTGCAGGTTGCACCCTGAGCATCCTGTTCGCC
TCTGACAGTTATGCCGCCACGGCCCTGAATGTCAGCCAGCAACCCCTGTTCCTAACCCAGGGCGTTGCTCCCAACCTGCT
GTTCACTCTAGATGACTCAGGCAGTATGGCCTGGGCTTACGTGCCCGACGGTATTAGCGGGAATAGCGGCAGAGCGGGAC
GTTCCAGCGATTACAACGCACTGTACTACAACCCCGATTATGCTTACCAAGTGCCCAAGAAATTGACACTGTCAGGCGAT
CAGATCATCGTTTCCGACTATCCAGTGCCACGCTTCACAGCAGCCTGGCAGGATGGCTACGCCCAAGGCTCCACCACCAA
CCTGAGCAATAACTATCGCCCTCAATGGGGAACCGGCTGGCTTGGTTGCATCGATAGCAGCTGCAATACCGGGAGAGCTT
ATTACTATACTTATAAGGTAAGCGCTAGCTGCCCTGCACAGCCGGTGAGCAGCTCCAACTCCTGTTATACCTACAATGCT
CTTCCTACCAGTCAGGAAAGCAACTTTGCGATATGGTACTCCTACTATCGCAACCGCATCCTGGCCACAAAGACCGCTGC
CAACCTGGCCTTTTACAGCCTGCCGGAAAACGTGCGTCTCACTTGGGGGGCCCTGAACACCTGTAGCATCGGCGCCAACA
GCAGAAGCTGCCAAAACAATGCCCTGCTCCAATTCAACAAGCAGCACAAAATCAATTTCTTCAATTGGCTGGCGAACAGC
CCGGCCAGCGGCGGTACTCCTCTGCATGCGGCTCTTGACCGAGCCGGACGCTTCTTGCAAACCAACGGCACAGCTTATAC
CACCGAAGACGGAAAGACATATTCCTGCCGGGCCAGCTATCACATCATGATGACCGACGGTATCTGGAACGGTCGGAACG
TCACCCCCGGCAATCTCGACAACCAGAACCAGACCTTTCCTGATAGCACCCTCTATAGGCCACAGCCCCCTTATGCCGAC
AGCAATGCCAGCTCATTGGCTGACCTGGCTTTCAAATACTGGACCACAGACTTACGTCCCAGCATCGACAATGACCTGAA
GCCTTTCATGGCCTACAAGAGTGGGGACGATTCCAAGGATTACTGGGACCCTCGCAACAACCCAGCCACTTGGCAACACA
TGGTCAACTTTACCGTTGGCCTAGGTCTTTCCTATTCGCTCACATTGAACTCTGCACCAACTTGGACAGGCAGCACCTTT
GGCAACTACGAGGAGTTGATGGCTGGAAGCAAGGCTTGGCCCAGCGTCGATAACGACGCCGCACCCGGTAACGTCTACGA
CCTCTGGCATGCAGCTATCAACTCTCGTGGAGACTTCTTTAGCGCGGAATCACCGGACTCTCTGGTTCAGGCTTTCAATA
AGATCCTGACACGGATTTCCGAGCGCAACACCTCCTCCTCCAAACCAGCAATGACTTCCGCGCTGCAGGATGACGGAACC
GGCGACAAGCTGATCCGCTACAGCTACCAGTCCAGCTTTGCCAGTGACAAGAACTGGGCGGGCGACCTTATACGTTACAA
GGTGGAGTCGACTTCCACCGGTTCGACCAAAACCCAGGAATGGAGCGCCGGCGCACTGCTGGACAACCGAGCTCCCGCTA
CCCGTAATATTTACATCGCCAGCAATAGCGGAACCAACCGCCTTAAGCCTTTCACATGGAGCAATATTGAGGGAAGTCAG
TTAGCCACTTGGCTGAACCGCAACCCGGACAAGGACAATCAGGCCGACACCAAAGGAGCACAGCGGGTCGACTTCATCCG
TGGCCAGCAGAATATGGATGGATTCCGGCAACGACAGGCGGTGTTAGGGGACATCGTGCACTCGTCTCCAGCCGTGGTCG
GACCGGCCCAATACCTCACTTATCTGGCCAACCCCATCGAACCCAGCGGCGACTACGGCACATTCAAGACAGAGGCAGAC
CAGCGCAGCCCTAGAGTTTATGTTGGATCCAACGATGGCATGTTGCATGGTTTCAACATCAAAACCGGCGTGGAAGAGTT
CGCTTTCATCCCTACAGCAGTATTCGAAAAGCTTAACAAGCTTACCGGCATCAGCTACCAGGGCGGTGCCCACCAATATT
TCGTCGACGCTACACCGGTCGTCAGCGATGCCTTTTTCGATGGAGCTTGGCACACTGTTCTGATCGGAACGCTTGGTGCT
GGAGGTCGCGGCCTGTTCGCACTCGATGTAACCAAGCCGGACGATGTCAAGCTGCTTTGGGAATACGATAGCAGTACCGA
CTCGGACCTTGGTTACACCTTCTCCAAACCTACCGTAGCCAGACTGCACAGCGGACAATGGGCAGTAGTTACCGGCAACG
GCTATGGAAGCGATAATGACAAGGCAGCTTTACTGCTGATTGATTTGAAAAAGGGAACGCTGATCAAGAAGCTGGAAGTC
CAAAGCGAGCGCGGAATAGCCAATGGCCTATCGACGCCTCGCCTGGCTGATAACAACAGCGATGGCATTGCTGACTACGC
CTATGCTGGCGATCTGCAGGGAAATATCTGGCGCTTCGATTTGATCGGCAATACCCGCAACGACGACCCAGACACAAATA
CCTCTATCAATCCCTTCAAGCCCGGAGATGTAGATCCTTCTGCTTTCAGAGTATCGTTCAGCGGCGCCCCGCTTTTCCGT
```

Fig. 2J

```
GCTCGCGCCGACAACAATACTCGTCAGCCCATCACGGCTCCGCCTACCTTGGTACGCCATCCTAGCCGTAAGGGCTACAT
CGTCATCGTAGGTACAGGAAAATACTTCGAGGACGATGACGCTCAGGCCGATACCAGCCGAGCCATGACGCTCTATGGTA
TCTGGGATCGCCAGACCAAGGGCGAAAGCGCAAACAGTACCCCAACCATCGACCGCAACGCCCTCACAGCCCAAACCATG
ACAACAGAGGCGAACTCCACATTCGGTAGCGTGAACAGGAATATTCGGCTTATTAGCCAAAACCCGGTGAAGTGGTACAA
AGACGGAGCAACCGGTACCGCGAACTCGGATGTGGCTAGCTATGGCTGGCGACTGAATCTGGAGGTCAATAGCAGCAAGA
AAGGCGAAATGATGATCGAAGATATGTTCGCTGCCGGCCAAGTGCTTCTATTGCAGACCTTGACACCGAACGACGACCCT
TGTGACAGCGGCTCTACCAGCTGGACCTACGGCCTCAATCCATATACTGGCGGACGTACCAGTTTCACCGTCTTCGATCT
CAAACGTGCGGGTATAGTGGACTCTGGCTCGGATTACAACGGCTCGGTCGTATCCGCCTTCCAACAGGATGGACTAGGTG
GCTTGGCCATTACCCAGAACGAACAGCGTCAATCCGAGGCTTGCACTGGTGATGAGTGCATCATCTTCAACCCCAGCGAC
AAGAGTAACGGACGACAAACCTGGCGGGTCGTCGAGGAGAAATGAACATGAACCCCTTACGTCTTCTCGCCACAGCTCTT
GCAGCTCTAGCTCTGGCTTGCCCAACCTTTGCCTTGAGTGCCACGAATACGTTCGAGAATGTGGGCGTGGTCGAGGATGT
TCATCCTGCCGCCGGTCTGGTAGTAGTCGATGGGCAGACATATCGCTTGCCCAACCGTGTCCAACAACAGGACTCGCCGG
TCATATTCTTGGTACGTCAGGGACAGACAGTGTCTTTCTCCGGCAAACTCACCAGCGACCTGCCAGAAATCGAGTCGTTC
TACATTATCAAGCAGGCCCCTCTCGTTCCCTTCGGATCGGAGCAGCAACAATGAAGTCGAACAGAGGCTTCACTCTCATC
GAGTTGATGATCGTCGTAGTAATCATCGCTATTCTTGCTGGTATCGCCTACCCCAGCTACGACGAATACGTGAAGCGCGG
GAATCGCACCGAAGGACAGGCATTACTCAGCGAAGCAGCCGCTACTAAGAGCGCTATTTTTCACAGAACAATACTTATA
TCACTACCCAAGCCGACATCGGCAAGCTGCATATGCGCAACACATCGGGCACCACAGTGAAGTCCTCCACAGGCAAATAC
AGCCTTACCGTCGATACGGTAGCCAACGACGGAGGTTATCGCCTTATCGCTAACCAGGCATTCAACGATCTTGATTGTGG
CAACCTGACCTTGACCGCCAACGGCGAGAAAGGCCGGACTGGAAGCAAGAAGAGCGTTGCAGAATGCTGGCGCTAAAGCG
CCGAGACAAGAAAAAGGCAAAGCCCGGCATAAGCCGGGCTTTTTCAGGTGCGCAAAAATTCCGATTACAAAGCCTTGACC
CGCAGTTCCTTGGGCATCGAGAAGGTAATGTTCTCCTCCCGTCCCTCCAGTTCCTGCTCTTCCGACGCCCCCCACTCACG
TAGCTGGGCGATCACTCCGCGCACCAGCACTTCCGGCGCGGAGGCGCCTGCGGTGATTCCGATGCGACGCACACCGTCGA
ACCAGCCGCGTTGCATGTCCTCGGCGCCGTCGATCAGGTAGGCCGGCGTGCCCATGCGCTCGGCGAGTTCGCGCAGGCGG
TTGGAGTTGGAACTGTTGGGGCTGCCCACCACCAGGACCATGTCGCACTGGTCGGCCAGTTCCTTCACGGCATCCTGGCG
GTTCTGGGTGGCATAGCAGATGTCGTTCTTGCGCGGCCCCTGGATCTGCGGGAACTTGGCGCGCAGGGCATCGATGACCT
TCGAGGTGTCGTCCATCGACAGGGTGGTCTGGGTCACGTAGTGCAGGGCTTCGGGCTTGCGCACCTCCAGCGCGGCGACG
TCGGCCTCGTCCTCCACCAGGTAGATGGCACCGCCGTTGCTGGCATCGTACTGGCCCATGGTGCCTTCCACCTCGGGGTG
GCCTTCATGCCCGATCAGCACGCATTCGTGGCCGTCGCGGCTGTAGCGCACCACTTCCATGTGCACCTTGGTCACCAGCG
GGCAGGTCGCGTCGAAAACCTTCAGGCCGCGCCCCTCGGCTTCCTTGCGGACCGCCTGGGAAACGCCGTGGGCGCTGAAG
ATGACGATGACGTTGTCCGGCACCTGATCGAGTTCCTCGACGAAGATGGCGCCGCGCTGGCGCAGGTTGTCCACGACGAA
CTTGTTGTGCACCACCTCGTGACGCACGTAGATCGGCGGGCCGAAGACATCGAGGGCACGGTTGACGATCTCGATGGCGC
GATCCACGCCGGCGCAGAAGCCGCGGGGATTGGCGAGTTTGATTTGCATGGCGGTCTCGTGGGCGACGCGGTGATTGGAC
GAATGAACCTTGCTACCGCCCTCCCCGCTTGGGAAGGGCGCAGCGACCGACGGTTCAGGCCGGCTGGACGTCGAT
```

Fig. 2K

>ORF2 (SEQ ID NO:2)
TCGCCGATCCAATGCCAAGGAGTACCTGGGCAATCAGAGCCTACTCACGGCTGCCGGGGCCGGCATTGCCAAGCTCCTGG
ACGCCGACGAGAACAACACCAGTACCGTCTTCAGCGGCAACGGCACCAGCTTCGGGACGACCGGAACCAACAGCAACTCG
GCCCTCAACAGCATCCTCTCCGGCGGCGTCAGCGACATCCGGCAGTGGATGAACAAGTTGTACGGGGAGGCCTTCGCCGC
CGTCTACGTGCAGCCAGGTGCGCGGGTCGCAGTGCATCTCGATCAGCAACTGGCGATCGACTATGA

>ORF3 (SEQ ID NO:4)
CGCCGATCCAATGCCAAGGAGTACCTGGGCAATCAGAGCCTACTCACGGCTGCCGGGGCCGGCATTGCCAAGCTCCTGGA
CGCCGACGAGAACAACACCAGTACCGTCTTCAGCGGCAACGGCACCAGCTTCGGGACGACCGGAACCAACAGCAACTCGG
CCCTCAACAGCATCCTCTCCGGCGGCGTCAGCGACATCCGGCAGTGGATGAACAAGTTGTACGGGGAGGCCTTCGCCGCC
GTCTACGTGCAGCCAGGTGCGCGGGTCGCAGTGCATCTCGATCAGCAACTGGCGATCGACTATGAACTCAAGGGCCGCAA
GGTCGATTACAGCTCTGGAGCCGCTCATGCAACAGCAGACTTGGACTAA

>ORF602c (SEQ ID NO:6)
TCGGCCTGGTCATTCGCGGAGGCATCCTGCTGCGGATCGATTGGGCGCCGCAGCGTTTGCCTGGCATCGAGGAGCAGCCG
GCCACGGCTGTTGCCTATCGAGCTGGTCGCACCTCGCTCCCAGACGTCGAGCATGTTGGCCTCGCCGTGGGGCAGCATCT
CCTCCTTGCTGGTGGAGCACGCTGCCAGGGTCAGCGCGCAGGCCAGGCCGGCGCAGAGACGAAGAAGGGGGTTAGTCCAA
GTCTGCTGTTGCATGAGCGGCTCCAGAGCTGTAATCGACCTTGCGGCCCTTGAGTTCATAGTCGATCGCCAGTTGCTGAT
CGAGATGCACTGCGACCCGCGCACCTGGCTGCACGTAGACGGCGGCGAAGGCCTCCCCGTACAACTTGTTCATCCACTGC
CGGATGTCGCTGACGCCGCCGGAGAGGATGCTGTTGAGGGCCGAGTTGCTGTTGGTTCCGGTCGTCCCGAAGCTGGTGCC
GTTGCCGCTGAAGACGGTACTGGTGTTGTTCTCGTCGGCGTCCAGGAGCTTGGCAATGCCGGCCCCGGCAGCCGTGAGTA
G

>ORF214 (SEQ ID NO:8)
ACAAGTTGTACGGGGAGGCCTTCGCCGCCGTCTACGTGCAGCCAGGTGCGCGGGTCGCAGTGCATCTCGATCAGCAACTG
GCGATCGACTATGAACTCAAGGGCCGCAAGGTCGATTACAGCTCTGGAGCCGCTCATGCAACAGCAGACTTGGACTAACC
CCTTCTTCGTCTCTGCGCCGGCCTGGCCTGCGCGCTGACCCTGGCAGCGTGCTCCACCAGCAAGGAGGAGATGCTGCCC
CACGGCGAGGCCAACATGCTCGACGTCTGGGAGCGAGGTGCGACCAGCTCGATAGGCAACAGCCGTGGCCGGCTGCTCCT
CGATGCCAGGCAAACGCTGCGGCGCCCAATCGATCCGCAGCAGGATGCCTCCGCGAATGACCAGGCCGACTACACCCGCA
CGGCCAGCAACGAGATCCACAGTCAGTTCAAACGACTGCCCAATCCCGACCTGGTGATGTATGTGTTCCCGCACCTGGCC
GGCAGCGATCCCGCCCCGGTACCGGGCTACACCACCGTGTTCCCCTTCTACCAGCGAGTCCAGTACGCCATGCCGGGCGA
ACGCACGGAGGACTATTGA

>ORF1242c (SEQ ID NO:10)
TCTCGTCCTGGGCGTAGAACTGGACAATCCAGGGTGAGGTTTCGTGCTCGTCGAAGGAGTTCTGCAGGGCTTCTTTCAAT
GCGTCCCGGGCGTTCTGCATCCAATTGGGATCGCGGCCCTCGGTGCCCAAGGGCACCAGTTCGAAGAATGCGGCGCGCGA
ACGCCCATCCTCCAGGAGCATCACTTGCTCGTCGGGCAGGTACTCAGCCCAGGGCAGCAGGTCTACGAACGATGGGTCGT
GATCGTAGAGGCGTGACGCTTCGGCCTGCGTGGCGCCATTCTTGCTCCCGGTGTTGGGCAGAGGAATACCCATGGCGGCC
AGTCGCGCCAGATAGCGCTCAGTCGCTTCTTCCGCGGCCGCTACGTCCAGCGCTCCTGAATCTTCGGGAGCGTCTGCCGG
TACCGACTGAGGCTGTGTGCGACCGCGCAGAAGGGTTTGAAAAAGCCCATCAATAGTCCTCCGTGCGTTCGCCCGGCAT
GGCGTACTGGACTCGCTGGTAGAAGGGGAACACGGTGGTGTAGCCCGGTACCGGGCGGGATCGCTGCCGGCCAGGTGCG
GGAACACATACATCACCAGGTCGGGATTGGGCAGTCGTTTGAACTGACTGTGGATCTCGTTGCTGGCCGTGCGGGTGTAG
TCGGCCTGGTCATTCGCGGAGGCATCCTGCTGCGGATCGATTGGGCGCCGCAGCGTTTGCCTGGCATCGAGGAGCAGCCG
GCCACGGCTGTTGCCTATCGAGCTGGTCGCACCTCGCTCCCAGACGTCGAGCATGTTGGCCTCGCCGTGGGGCAGCATCT
CCTCCTTGCTGGTGGAGCACGCTGCCAGGGTCAGCGCGCAGGCCAGGCCGGCGCAGAGACGAAGAAGGGGGTTAGTCCAA
GTCTGCTGTTGCATGAGCGGCTCCAGAGCTGTAATCGACCTTGCGGCCCTTGA

Fig. 3-1

>ORF594 (SEQ ID NO:12)
CCAGGCCGACTACACCCGCACGGCCAGCAACGAGATCCACAGTCAGTTCAAACGACTGCCCAATCCCGACCTGGTGATGT
ATGTGTTCCCGCACCTGGCCGGCAGCGATCCCGCCCCGGTACCGGGCTACACCACCGTGTTCCCCTTCTACCAGCGAGTC
CAGTACGCCATGCCGGGCGAACGCACGGAGGACTATTGATGGGCTTTTTTCAAACCCTTCTGCGCGGTCGCACACAGCCT
CAGTCGGTACCGGCAGACGCTCCCGAAGATTCAGGAGCGCTGGACGTAGCGGCCGCGGAAGAAGCGACTGAGCGCTATCT
GGCGCGACTGGCCGCCATGGGTATTCCTCTGCCCAACACCGGGAGCAAGAATGGCGCCACGCAGGCCGAAGCGTCACGCC
TCTACGATCACGACCCATCGTTCGTAGACCTGCTGCCCTGGGCTGAGTACCTGCCCGACGAGCAAGTGATGCTCCTGGAG
GATGGGCGTTCGCGCGCCGCATTCTTCGAACTGGTGCCCTTGGGCACCGAGGGCCGCGATCCCAATTGGATGCAGAACGC
CCGGGACGCATTGAAAGAAGCCCTGCAGAACTCCTTCGACGAGCACGAAACCTCACCCTGGATTGTCCAGTTCTACGCCC
AGGACGAGATCAGCTGGGACAATTTCCAGGAGCAGTTGAGGCAGTACGTCCATCCTCGAGCGCGAGGATCGGCCTTCAGC
GAGATGTACCTGGCGCTCATGAAGCATCACCTGGAGGGCATTTCGAAGCCGGGCGGACTGTTCGTCGACACCGCCGTCAG
CAAGCTGCCCTGGCGAGGACAACAGCGCCGCGTGCGGATGGTCGTCTACCGCCGGATCCGCAAGGAGGATGCGCAGATTC
GCGGACAGGACCCGGCGGCGTACCTGAAATCCATCTGCGAGCGTATCCAAGGCGGCCTGGCGAACGCCGGCATCGTCGCT
TCGCGCATGGGCGGACAGGAGATCAGGAACTGGTTGATCCGCTGGTTCAACCCGCACCCGGATCACCTCGGCCAGGCCGA
GGCGGACCTACGTCGCTTCTACGAACTGGTATGCCGTCCGGACGAACCGATCCTGCAGGATGAATTGCCACTGGCCGACG
GCACTGACTTCTCCCAGAACCTGTTCTATCGGCAGCCTGTTTCCGATGCCACCCAGGGCGTATGGCTCTTCGATGCCATG
CCGCACCGAGTGATTGTGGTCGACCAGTTGAACAAAGCGCCGCTGACAGGCCACTTCACCGGCGAGACGCTCAAAGGCGA
TGGCCTCAACGCCCTGTTCGATCGAATGCCCGAGGACACGCTGCTGTGCATCACCATGGTCGTGACGCCGCAGGACATGC
TGGAAGGGCATCTGCAGCAGCTCTCGAAAAAGGCCGTTGGTGACACCCAGGCCTCGATCCACACCCGCGAGGACGTGGCC
ACCGTTCGACGCCTGATCGGCCGGGAGCACAAGCTCTATCGCGGAGCGATCGCTCTGTTCGTGCGCGGCCGCGACCATAC
CCAGTTGGAGGAACGCTGCATCACCCTGAGCAACGTACTGCTCGGCGCCGGCCTGGTGCCGGTCGAACCGCAGAACGAAG
TCGGACCGCTGAACAGCTACCTGCGCTGGCTCCCCTCAAACTTCGATCCAAACGAGAAGCGAGCCCTGGAGTGGTACACC
CAGATGATGTTCGCTCAGCACATCGCCAACCTGTCGCCCATCTGGGGGCGCACCACCGGTACCGGACACCCTGGCTTCAC
GCTGTTCAACCGTGGCGGCGCGCCGTTGACCTTCGACCCGTTCAACAAGCTGGACCGGCAGATGAATGCCCACGGCTTCA
TCTTCGGGCCAACTGGCTCCGGCAAGTCGGCGTCCCTGACCAACCTCATCTGCCAGATGCTCGCCATGTACCTGCCGCGG
ATGTTCGTCGCGGAAGCGGGCAACAGCTTCGGCCTGCTGGCCGACTTAGCCAAGCGGTTTGGCCTCTCGGTCCACCGGGT
GCGCCTCGCCCCGGGCTCCGGCGTCAGCCTGGCGCCGTTCGCGGACGCCATCAAGCTGGTCGAGAGCCCCGACCAAGTGA
AGGTGCTGGACGCCGAAGACATCGAGGCCTCGGACTCGGTCCAGGGCAGCAAGGCCGACCTCGAGGACGACCAGCGAGAC
ATCCTGGGCGAGATGGAGATCGTCGCCCGCCTCATGATTACCGGTGGCGAAGAGAAGGAAGATGCGCGCCTGACCCGTGC
CGATCGCAGCGCCGTCCGCCAGGCGATCCTGGCGGCGGCCAGGACCTGCGCCGCCGCGAACCGCACGGTACTGACCCAAG
ACGTGCGCGATGCGCTCTACGAGGCCTCCAGGAGCGATAGCACCGCGCCAGAACGCCGCGCGCGGATCGCCGAAATGGCG
GAAGCCATGCAGATGTTCTGCATGGGCGCCGACGGCGAGATGTTCAATCGCGAAGGCACGCCCTGGCCTGAGGCCGACCT
TACCGTGGTGGATTTCGCAACGTACGCGCGCGAAGGCTACGCCGCCCAGCTCGGGATCGCCTACATCTCGCTGCTGAACA
CCGTGAACAACATCGCCGAACGCGACCAGTTCAAGGGCCGGCCAATCGTCAAGATCACCGATGAGGGGCACATCATCACC
AAGCACCCGCTGCTGCTGCCCTACGCCATGAAGATCACCAAGATGTGGCGGAAACTGGGCGCCTGGTTCTGGCTCGCCAC
CCAGAACATCGACGACATCCCAGCCTCCGGGGCGCCGATGCTGAACATGATCGAGTGGTGGTTTGTGCCTGAACATGCCCC
CCGACGAAGTAGAGAAGATATCCAGGTTCCGCGAGCTGTCGCCGGCGCAGAAGTCGATGATGCTCTCGGCCCGCAAGGAA
AGCGGCAAGTTCACCGAGGGCGTGCTCCTGGCCAAGGGCAAAGAATACCTCGTCCGTGTGGTTCCCCCGAGTCTCTACCT
GGCCCTGGCCATGACCGAAAACGAAGAAAAGAACCAGCGCTACAACATCATGCAAGCCACCGGCTGCGACGAGCTCGAGG
CGGCCTTGCAGGTCGCAGCGGATCTCGACAAGGCGCGCGGCCTGCCACCCTTCCCCATTGTTTTCCCAGACCAACCGGCA
GTGGAGTGCCAGGACGAATGA

>ORF1040 (SEQ ID NO:14)
GTACCTGCCCGACGAGCAAGTGATGCTCCTGGAGGATGGGCGTTCGCGCGCCGCATTCTTCGAACTGGTGCCCTTGGGCA
CCGAGGGCCGCGATCCCAATTGGATGCAGAACGCCCGGGACGCATTGAAAGAAGCCCTGCAGAACTCCTTCGACGAGCAC
GAAACCTCACCCTGGATTGTCCAGTTCTACGCCCAGGACGAGATCAGCTGGGACAATTTCCAGGAGCAGTTGAGGCAGTA
CGTCCATCCTCGAGCGCGAGGATCGGCCTTCAGCGAGATGTACCTGGCGCTCATGAAGCATCACCTGGAGGGCATTTCGA
AGCCGGGCGGACTGTTCGTCGACACCGCCGTCAGCAAGCTGCCCTGGCGAGGACAACAGCGCCGCGTGCGGATGGTCGTC
TACCGCCGGATCCGCAAGGAGGATGCGCAGATTCGCGGACAGGACCCGGCGGCGTACCTGAAATCCATCTGCGAGCGTAT
CCAAGGCGGCCTGGCGAACGCCGGCATCGTCGCTTCGCGCATGGGCGGACAGGAGATCAGGAACTGGTTGATCCGCTGGT
TCAACCCGCACCCGGATCACCTCGGCCAGGCCGAGGCGGACCTACGTCGCTTCTACGAACTGGTATGCCGTCCGGACGAA
CCGATCCTGCAGGATGA

Fig. 3-2

>ORF1640c (SEQ ID NO:16)
GTCCGCCTCGGCCTGGCCGAGGTGATCCGGGTGCGGGTTGAACCAGCGGATCAACCAGTTCCTGATCTCCTGTCCGCCCA
TGCGCGAAGCGACGATGCCGGCGTTCGCCAGGCCGCCTTGGATACGCTCGCAGATGGATTTCAGGTACGCCGCCGGGTCC
TGTCCGCGAATCTGCGCATCCTCCTTGCGGATCCGGCGGTAGACGACCATCCGCACGCGGCGCTGTTGTCCTCGCCAGGG
CAGCTTGCTGACGGCGGTGTCGACGAACAGTCCGCCCGGCTTCGAAATGCCCTCCAGGTGATGCTTCATGAGCGCCAGGT
ACATCTCGCTGAAGGCCGATCCTCGCGCTCGAGGATGGACGTACTGCCTCAACTGCTCCTGGAAATTGTCCCAGCTGATC
TCGTCCTGGGCGTAGAACTGGACAATCCAGGGTGA

>ORF2228c (SEQ ID NO:18)
GGGGAGCCAGCGCAGGTAGCTGTTCAGCGGTCCGACTTCGTTCTGCGGTTCGACCGGCACCAGGCCGGCGCCGAGCAGTA
CGTTGCTCAGGGTGATGCAGCGTTCCTCCAACTGGGTATGGTCGCGGCCGCGCACGAACAGAGCGATCGCTCCGCGATAG
AGCTTGTGCTCCCGGCCGATCAGGCGTCGAACGGTGGCCACGTCCTCGCGGGTGTGGATCGAGGCCTGGGTGTCACCAAC
GGCCTTTTTCGAGAGCTGCTGCAGATGCCCTTCCAGCATGTCCTGCGGCGTCACGACCATGGTGATGCACAGCAGCGTGT
CCTCGGGCATTCGATCGAACAGGGCGTTGAGGCCATCGCCTTTGAGCGTCTCGCCGGTGAAGTGGCCTGTCAGCGGCGCT
TTGTTCAACTGGTCGACCACAATCACTCGGTGCGGCATGGCATCGAAGAGCCATACGCCCTGGGTGGCATCGGAAACAGG
CTGCCGATAGAACAGGTTCTGGGAGAAGTCAGTGCCGTCGGCCAGTGGCAATTCATCCTGCAGGATCGGTTCGTCCGGAC
GGCATACCAGTTCGTAGAAGCGACGTAG

>ORF2068c (SEQ ID NO:20)
AGCTTGTGCTCCCGGCCGATCAGGCGTCGAACGGTGGCCACGTCCTCGCGGGTGTGGATCGAGGCCTGGGTGTCACCAAC
GGCCTTTTTCGAGAGCTGCTGCAGATGCCCTTCCAGCATGTCCTGCGGCGTCACGACCATGGTGATGCACAGCAGCGTGT
CCTCGGGCATTCGATCGAACAGGGCGTTGAGGCCATCGCCTTTGAGCGTCTCGCCGGTGAAGTGGCCTGTCAGCGGCGCT
TTGTTCAACTGGTCGACCACAATCACTCGGTGCGGCATGGCATCGAAGAGCCATACGCCCTGGGTGGCATCGGAAACAGG
CTGCCGATAG

>ORF1997 (SEQ ID NO:22)
CACCCAGGCCTCGATCCACACCCGCGAGGACGTGGCCACCGTTCGACGCCTGATCGGCCGGGAGCACAAGCTCTATCGCG
GAGCGATCGCTCTGTTCGTGCGCGGCCGCGACCATACCCAGTTGGAGGAACGCTGCATCACCCTGAGCAACGTACTGCTC
GGCGCCGGCCTGGTGCCGGTCGAACCGCAGAACGAAGTCGGACCGCTGAACAGCTACCTGCGCTGGCTCCCCTCAAACTT
CGATCCAAACGAGAAGCGAGCCCTGGAGTGGTACACCCAGATGATGTTCGCTCAGCACATCGCCAACCTGTCGCCCATCT
GGGGGCGCACCACCGGTACCGGACACCCTGGCTTCACGCTGTTCAACCGTGGCGGCGCGCCGTTGACCTTCGACCCGTTC
AACAAGCTGGACCGGCAGATGAATGCCCACGGCTTCATCTTCGGGCCAACTGGCTCCGGCAAGTCGGCGTCCCTGACCAA
CCTCATCTGCCAGATGCTCGCCATGTACCTGCCGCGGATGTTCGTCGCGGAAGCGGGCAACAGCTTCGGCCTGCTGGCCG
ACTTAGCCAAGCGGTTTGGCCTCTCGGTCCACCGGGTGCGCCTCGCCCCGGGCTCCGGCGTCAGCCTGGCGCCGTTCGCG
GACGCCATCAAGCTGGTCGAGAGCCCCGACCAAGTGAAGGTGCTGGACGCCGAAGACATCGAGGCCTCGGACTCGGTCCA
GGGCAGCAAGGCCGACCTCGAGGACGACCAGCGAGACATCCTGGGCGAGATGGAGATCGTCGCCCGCCTCATGATTACCG
GTGGCGAAGAGAAGGAAGATGCGCGCCTGACCCGTGCCGATCGCAGCGCCGTCCGCCAGGCGATCCTGGCGGCGGCCAGG
ACCTGCGCCGCCGCGAACCGCACGGTACTGACCCAAGACGTGCGCGATGCGCTCTACGAGGCCTCCAGGAGCGATAG

>ORF2558c (SEQ ID NO:24)
GTCGGCCAGCAGGCCGAAGCTGTTGCCCGCTTCCGCGACGAACATCCGCGGCAGGTACATGGCGAGCATCTGGCAGATGA
GGTTGGTCAGGGACGCCGACTTGCCGGAGCCAGTTGGCCCGAAGATGAAGCCGTGGGCATTCATCTGCCGGTCCAGCTTG
TTGAACGGGTCGAAGGTCAACGGCGCGCCGCCACGGTTGAACAGCGTGAAGCCAGGGTGTCCGGTACCGGTGGTGCGCCC
CCAGATGGGCGACAGGTTGGCGATGTGCTGAGCGAACATCATCTGGGTGTACCACTCCAGGGCTCGCTTCTCGTTTGGAT
CGAAGTTTGA

Fig. 3-3

>ORF2929c (SEQ ID NO:26)
AGCGCATCGCGCACGTCTTGGGTCAGTACCGTGCGGTTCGCGGCGGCGCAGGTCCTGGCCGCCGCCAGGATCGCCTGGCG
GACGGCGCTGCGATCGGCACGGGTCAGGCGCGCATCTTCCTTCTCTTCGCCACCGGTAATCATGAGGCGGGCGACGATCT
CCATCTCGCCCAGGATGTCTCGCTGGTCGTCCTCGAGGTCGGCCTTGCTGCCCTGGACCGAGTCCGAGGCCTCGATGTCT
TCGGCGTCCAGCACCTTCACTTGGTCGGGGCTCTCGACCAGCTTGATGGCGTCCGCGAACGGCGCCAGGCTGACGCCGGA
GCCCGGGCGAGGCGCACCCGGTGGACCGAGAGGCCAAACCGCTTGGCTAAGTCGGCCAGCAGGCCGAAGCTGTTGCCCG
CTTCCGCGACGAACATCCGCGGCAGGTACATGGCGAGCATCTGGCAGATGAGGTTGGTCAGGGACGCCGACTTGCCGGAG
CCAGTTGGCCCGAAGATGAAGCCGTGGGCATTCATCTGCCGGTCCAGCTTGTTGAACGGGTCGAAGGTCAACGGCGCGCC
GCCACGGTTGAACAGCGTGAAGCCAGGGTGTCCGGTACCGGTGGTGCGCCCCAGATGGGCGACAGGTTGGCGATGTGCT
GA

>ORF3965c (SEQ ID NO:28)
GCGCCTGTTGGGCCGTATCAGGCTGTGGATGTTGTTGCAGCCATTCATCCAAGAGCTGCTTTATCTGCGGGACGATATCC
CGGCGATCGACTGCCCTCAGTTGAATCTGCTGCAGCTCCTCTATCAGTACAGGAGCGCATATCCTTAGCGTCTGCAGGGC
ATCCTCTTCGGGGTTCTGCAGGATCTGGGTCAGGTTGTCGATCAGGTTCTGGGTCAGCGAATTCAGAACTCTCATTCGTC
CTGGCACTCCACTGCCGGTTGGTCTGGGAAAACAATGGGGAAGGGTGGCAGGCCGCGCGCCTTGTCGAGATCCGCTGCGA
CCTGCAAGGCCGCCTCGAGCTCGTCGCAGCCGGTGGCTTGCATGATGTTGTAGCGCTGGTTCTTTTCTTCGTTTTCGGTC
ATGGCCAGGGCCAGGTAGAGACTCGGGGGAACCACACGGACGAGGTATTCTTTGCCCTTGGCCAGGAGCACGCCCTCGGT
GAACTTGCCGCTTTCCTTGCGGGCCGAGAGCATCATCGACTTCTGCGCCGGCGACAGCTCGCGGAACCTGGATATCTTCT
CTACTTCGTCGGGGGGCATGTTCAGGCACAACCACCACTCGATCATGTTCAGCATCGGCGCCCCGGAGGCTGGGATGTCG
TCGATGTTCTGGGTGGCGAGCCAGAACCAGGCGCCCAGTTTCCGCCACATCTTGGTGATCTTCATGGCGTAGGGCAGCAG
CAGCGGGTGCTTGGTGATGATGTGCCCCTCATCGGTGATCTTGACGATTGGCCGGCCCTTGAACTGGTCGCGTTCGGCGA
TGTTGTTCACGGTGTTCAGCAGCGAGATGTAGGCGATCCCGAGCTGGGCGGCGTAGCCTTCGCGCGCGTACGTTGCGAAA
TCCACCACGGTAAGGTCGGCCTCAGGCCAGGGCGTGCCTTCGCGATTGAACATCTCGCCGTCGGCGCCCATGCAGAACAT
CTGCATGGCTTCCGCCATTTCGGCGATCCGCGCGCGGCGTTCTGGCGCGGTGCTATCGCTCCTGGAGGCCTCGTAGAGCG
CATCGCGCACGTCTTGGGTCAGTACCGTGCGGTTCGCGGCGGCGCAGGTCCTGGCCGCCGCCAGGATCGCCTGGCGGACG
GCGCTGCGATCGGCACGGGTCAGGCGCGCATCTTCCTTCTCTTCGCCACCGGTAATCATGAGGCGGGCGACGATCTCCAT
CTCGCCCAGGATGTCTCGCTGGTCGTCCTCGAGGTCGGCCTTGCTGCCCTGGACCGAGTCCGAGGCCTCGATGTCTTCGG
CGTCCAGCACCTTCACTTGGTCGGGGCTCTCGACCAGCTTGATGGCGTCCGCGAACGGCGCCAGGCTGACGCCGGAGCCC
GGGGCGAGGCGCACCCGGTGGACCGAGAGGCCAAACCGCTTGGCTAA

>ORF3218 (SEQ ID NO:30)
GGGGCACATCATCACCAAGCACCCGCTGCTGCTGCCCTACGCCATGAAGATCACCAAGATGTGGCGGAAACTGGGCGCCT
GGTTCTGGCTCGCCACCCAGAACATCGACGACATCCCAGCCTCCGGGGCGCCGATGCTGAACATGATCGAGTGGTGGTTG
TGCCTGAACATGCCCCCCGACGAAGTAGAGAAGATATCCAGGTTCCGCGAGCTGTCGCCGGCGCAGAAGTCGATGATGCT
CTCGGCCCGCAAGGAAAGCGGCAAGTTCACCGAGGGCGTGCTCCTGGCCAAGGGCAAAGAATACCTCGTCCGTGTGGTTC
CCCCGAGTCTCTACCTGGCCCTGGCCATGACCGAAAACGAAGAAAAGAACCAGCGCTACAACATCATGCAAGCCACCGGC
TGCGACGAGCTCGAGGCGGCCTTGCAGGTCGCAGCGGATCTCGACAAGGCGCGCGGCCTGCCACCCTTCCCCATTGTTTT
CCCAGACCAACCGGCAGTGGAGTGCCAGGACGAATGAGAGTTCTGAATTCGCTGACCCAGAACCTGATCGACAACCTGAC
CCAGATCCTGCAGAACCCCGAAGAGGATGCCCTGCAGACGCTAAGGATATGCGCTCCTGTACTGATAGAGGAGCTGCAGC
AGATTCAACTGAGGGCAGTCGATCGCCGGGATATCGTCCCGCAGATAAAGCAGCTCTTGGATGAATGGCTGCAACAACAT
CCACAGCCTGATACGGCCCAACAGGCGCTCATTGAGGCCGTGGACCGCGCGGAGATCCTACAGCGGAGGCAAGCGTGA

>ORF3568 (SEQ ID NO:32)
CCGAAAACGAAGAAAAGAACCAGCGCTACAACATCATGCAAGCCACCGGCTGCGACGAGCTCGAGGCGGCCTTGCAGGTC
GCAGCGGATCTCGACAAGGCGCGCGGCCTGCCACCCTTCCCCATTGTTTTCCCAGACCAACCGGCAGTGGAGTGCCAGGA
CGAATGAGAGTTCTGAATTCGCTGACCCAGAACCTGATCGACAACCTGACCCAGATCCTGCAGAACCCCGAAGAGGATGC
CCTGCAGACGCTAAGGATATGCGCTCCTGTACTGATAGAGGAGCTGCAGCAGATTCAACTGAGGGCAGTCGATCGCCGGG
ATATCGTCCCGCAGATAAAGCAGCTCTTGGATGA

Fig. 3-4

>ORF4506c (SEQ ID NO:34)
GTCAATAAGTTCGTTGTCTTTCGCACATTTCTCCAGTCGAGCCTGGTCCAGTTCAGGAAAGTCCAATGTGCCGCCAGGCA
GCCCGCCCCCGTTGCCGGCCGACTGAGCGAAGATCGCATCGATAGCGCTCCAGAAGGCTTTGGCGCCGCCTTGGATCCCC
GCGCACTCCACCAGGCGAGCCTGGTGGCGGGCCGCCTCGCCATGCATCTGCAGGGGAAGATGGCGCCAAACCAGGTTCAC
GTCCGGATGGCTGTCTACCCAGCGCTTAAGCCGCGGGGTGTAGACCTTGCAGAAGGGGCACTCCAGGTCGGCGTATTCAT
TGATCGTCCAGCGCGCTTTCGCATCGCCGTAGAGGCTGTGGTTGGCTGGCAGGCCCTTCACCAGAAGCTCTACCCCTACG
GCGGATGCAGCCAGCAAGACCAGCAGCAGCCCCGCCCAGGGCAGGGCGGGACCTTGAAATCGTTTGGCTGCCCAGCCGCC
CTTCAAGAGTCTCACGCTTGCCTCCGCTGTAGGATCTCCGCGCGGTCCACGGCCTCAATGAGCGCCTGTTGGGCCGTATC
AGGCTGTGGATGTTGTTGCAGCCATTCATCCAAGAGCTGCTTTATCTGCGGGACGATATCCCGGCGATCGACTGCCCTCA
GTTGA

>ORF3973 (SEQ ID NO:36)
GGCCGTGGACCGCGCGGAGATCCTACAGCGGAGGCAAGCGTGAGACTCTTGAAGGGCGGCTGGGCAGCCAAACGATTTCA
AGGTCCCGCCCTGCCCTGGGCGGGGCTGCTGCTGGTCTTGCTGGCTGCATCCGCCGTAGGGGTAGAGCTTCTGGTGAAGG
GCCTGCCAGCCAACCACAGCCTCTACGGCGATGCGAAAGCGCGCTGGACGATCAATGAATACGCCGACCTGGAGTGCCCC
TTCTGCAAGGTCTACACCCCGCGGCTTAAGCGCTGGGTAGACAGCCATCCGGACGTGAACCTGGTTTGGCGCCATCTTCC
CCTGCAGATGCATGGCGAGGCGGCCCGCCACCAGGCTCGCCTGGTGGAGTGCGCGGGGATCCAAGGCGGCGCCAAAGCCT
TCTGGAGCGCTATCGATGCGATCTTCGCTCAGTCGGCCGGCAACGGGGCGGGCTGCCTGGCGGCACATTGGACTTTCCT
GAACTGGACCAGGCTCGACTGGAGAAATGTGCGAAAGACAACGAACTTATTGACTCAGATATCAAGTTGGACATCGACAT
TGCACGGTCGAAGGGCATTACAGCGACCCCGACCCTCGTCATCCGGGACAACCAGACGGGACGAAGCGTGAAGCTTGAAG
GCATGGCCGACGAGACCACGTTGCTGTCGGCGATAGACTGGCTAGCCAAGGATCTCTAG

>ORF4271 (SEQ ID NO:38)
ACCTGGTTTGGCGCCATCTTCCCCTGCAGATGCATGGCGAGGCGGCCCGCCACCAGGCTCGCCTGGTGGAGTGCGCGGGG
ATCCAAGGCGGCGCCAAAGCCTTCTGGAGCGCTATCGATGCGATCTTCGCTCAGTCGGCCGGCAACGGGGCGGGCTGCC
TGGCGGCACATTGGACTTTCCTGAACTGGACCAGGCTCGACTGGAGAAATGTGCGAAAGACAACGAACTTATTGACTCAG
ATATCAAGTTGGACATCGACATTGCACGGTCGAAGGGCATTACAGCGACCCCGACCCTCGTCATCCGGGACAACCAGACG
GGACGAAGCGTGA

>ORF4698 (SEQ ID NO:40)
GAAATCGGCGAGGATTCCAACATCCCTCTTTTGGTCCTCCAGGATGCCCTGCACTTCACCTGGCAGAACCTCGACCTCCT
CCCCATCCACAATCTTTACCATTCTCTTGTGGCCGGAGCTGGTGAGGCTAAGCCTCAACTCCATTGCCGGCCGAGCATTG
ATGTAAATGCTCTCGAGCAAGCGCTCCATGACTTCGACCACTCCTTAATATCAGTTAGCCAGCTACATACAGGAATTATG
CTACCCAGGACATGCAGGCGTCACCCCTACTTATGTACGTGGCAGCGTTCGATCACGGCTCGAAAAAATACACCACCTAC
GAGTTGA

>ORF5028 (SEQ ID NO:42)
TTTCCTGCTGCCCTATCGGAAGTGATCCTGTCTGCTGTCTGTACCTTTCTAGAACCGGTACAGACCCATGCCTCTTCATC
ACTCCCCCCTGGCCGGCGGCCACCAACGCTGGCCGTTGGCGTACTACTGGTACTGCTGAGCAGCGCGAGTCAGGCCGAA
ACCTGGGTCATCACCGACAAGGCTCATCCGGTCTCTGCCACCGGATCGTCGCGCGTTCTGTTTCTGGACGCCCAGGAACA
CCTCGAGGAGCAACTGACTGCGGCCTTGCCCCAGGATCCACAGCATGCTCAAGCGGCGTTTAA

>ORF5080 (SEQ ID NO:44)
AACCGGTACAGACCCATGCCTCTTCATCACTCCCCCCCTGGCCGGCGGCCACCAACGCTGGCCGTTGGCGTACTACTGGT
ACTGCTGAGCAGCGCGAGTCAGGCCGAAACCTGGGTCATCACCGACAAGGCTCATCCGGTCTCTGCCACCGGATCGTCGC
GCGTTCTGTTTCTGGACGCCCAGGAACACCTCGAGGAGCAACTGACTGCGGCCTTGCCCCAGGATCCACAGCATGCTCAA
GCGGCGTTTAAGCGATTGCTACAAAGCCCCGATGGGCGCCGCCTGCAGGCAGAGCTGGTCAAGGCACAACAAGACGTCGC
CGATGCGTGGAGTCTCGGTGTCGAGAAGATCCCTGCCGTAGTAGTCGATAGGCAGTACGTGGTCTACGGCGAACCGGATG
TTTCGCGCGCTCTTGAGCTAATCGCCAAGGCCAGGAGGTCGCGCTGA

Fig. 3-5

>ORF6479c (SEQ ID NO:46)
TTCGTCTCCGTGTCCTTATTGGAAGTCGGTACTGCAGATGAACATCTGCCCCTTGCGCTGGCAGCAGGAGTAGGGACGCC
AGAGCGCCCAGGCGTGCTCCCCGTCGACGGCTTGCGTCTTCGGCCCAGAGTTGGGAAACACCGCGCAGTTGAGGCTCAGG
GATGGGGTCAGCTCCTGCCATTTCCCGGTCGAGGCATCGCCCTCTTTCAGCTCGCCCGCCGGCCAGTAGCCGTCCTTGGG
GGCTGCGCGCATGGGGAGGTAGACGTGGAGCTGGCCGATTCGCGTGGTGATATCGCCGGCGCGCTGGGCGATGACGGCTG
CCGTCTTGTAGTCGTCGGTCTGGTGCAGGAAGCCGCTGCGCGGATAGAGGTTCCCCCACATGTCGCCGGAGAAGATTCCA
CCCACCTCGCGCAGCCCTGGGACCAACGCTTCGGGGTACACCTGCTCGGGAATTCCATGCCGCCAGCCAATGGCGTCCAG
TGTGCTGAGAAAGTACGGCACCAGCGGGACGGTGGCGCCAGGGCAAACGTACCCAGAGGCGCTGGCGAACCGGCTGAACG
TGGCGCCACCAGGATGGCCGATCACATCCGCTTCCTTGAAGCGGCCGATGCTGTTCTCGGCCTTGTAGTTTGTGGTCGCG
TCATTGCCGGCCTGGGCGAGTGGATTCGGTGTACCCAGCGCCGATACCTCGGTCCAGGGGTTGCTCCCGGTATTCGCGTA
GCTGGAGACGACTGCGTCAGGCACGTAGTGGCGGACCTTGACCGACGTCTTCACTTTGCAGCCATGCGGGCCGCAGAGCA
GCCAGTAACAGATCCCGACGACCTTGTATTCGAGGCACTGAGGGGAAAGGGTGGAGGAGACGATGGCAGCGCTGTTGATC
GCGGCCGAGGCCGTGAACGAGAGGCTGAAGGTGGCGGCCGCCGCTGCCAGGCGGCGGAGGTTGAGGCTGGTCATCAGCGC
GACCTCCTGGCCTTGGCGATTAGCTCAAGAGCGCGCGAAACATCCGGTTCGCCGTAG

>ORF5496 (SEQ ID NO:48)
GCTAATCGCCAAGGCCAGGAGGTCGCGCTGATGACCAGCCTCAACCTCCGCCGCCTGGCAGCGGCGGCCGCCACCTTCAG
CCTCTCGTTCACGGCCTCGGCCGCGATCAACAGCGCTGCCATCGTCTCCTCCACCCTTTCCCCTCAGTGCCTCGAATACA
AGGTCGTCGGGATCTGTTACTGGCTGCTCTGCGGCCCGCATGGCTGCAAAGTGAAGACGTCGGTCAAGGTCCGCCACTAC
GTGCCTGACGCAGTCGTCTCCAGCTACGCGAATACCGGGAGCAACCCCTGGACCGAGGTATCGGCGCTGGGTACACCGAA
TCCACTCGCCCAGGCCGGCAATGACGCGACCACAAACTACAAGGCCGAGAACAGCATCGGCCGCTTCAAGGAAGCGGATG
TGATCGGCCATCCTGGTGGCGCCACGTTCAGCCGGTTCGCCAGCGCCTCTGGGTACGTTTGCCCTGGCGCCACCGTCCCG
CTGGTGCCGTACTTTCTCAGCACACTGGACGCCATTGGCTGGCGGCATGGAATTCCCGAGCAGGTGTACCCCGAAGCGTT
GGTCCCAGGGCTGCGCGAGGTGGGTGGAATCTTCTCCGGCGACATGTGGGGGAACCTCTATCCGCGCAGCGGCTTCCTGC
ACCAGACCGACGACTACAAGACGGCAGCCGTCATCGCCCAGCGCGCCGGCGATATCACCACGCGAATCGGCCAGCTCCAC
GTCTACCTCCCCATGCGCGCAGCCCCCAAGGACGGCTACTGGCCGGCGGGCGAGCTGAAAGAGGGCGATGCCTCGACCGG
GAAATGGCAGGAGCTGACCCCATCCCTGAGCCTCAACTGCGCGGTGTTTCCCAACTCTGGGCCGAAGACGCAAGCCGTCG
ACGGGGAGCACGCCTGGGCGCTCTGGCGTCCCTACTCCTGCTGCCAGCGCAAGGGGCAGATGTTCATCTGCAGTACCGAC
TTCCAATAA

Fig. 3-6

>ORF5840 (SEQ ID NO:50)
CGCGACCACAAACTACAAGGCCGAGAACAGCATCGGCCGCTTCAAGGAAGCGGATGTGATCGGCCATCCTGGTGGCGCCA
CGTTCAGCCGGTTCGCCAGCGCCTCTGGGTACGTTTGCCCTGGCGCCACCGTCCCGCTGGTGCCGTACTTTCTCAGCACA
CTGGACGCCATTGGCTGGCGGCATGGAATTCCCGAGCAGGTGTACCCCGAAGCGTTGGTCCCAGGGCTGCGCGAGGTGGG
TGGAATCTTCTCCGGCGACATGTGGGGGAACCTCTATCCGCGCAGCGGCTTCCTGCACCAGACCGACGACTACAAGACGG
CAGCCGTCATCGCCCAGCGCGCCGGCGATATCACCACGCGAATCGGCCAGCTCCACGTCTACCTCCCCATGCGCGCAGCC
CCCAAGGACGGCTACTGGCCGGCGGGCGAGCTGAAAGAGGGCGATGCCTCGACCGGGAAATGGCAGGAGCTGACCCCATC
CCTGAGCCTCAACTGCGCGGTGTTTCCCAACTCTGGGCCGAAGACGCAAGCCGTCGACGGGGAGCACGCCTGGGCGCTCT
GGCGTCCCTACTCCTGCTGCCAGCGCAAGGGGCAGATGTTCATCTGCAGTACCGACTTCCAATAAGGACACGGAGACGAA
TCATGCGAATGAACATCACCTCGGTCGCGCTAATGTGGCTGCTCGCAGCGCAACTTGCCCAGGCCGACGACCCGATCAAC
GTGTCCAAGACCGGCACGGTGCTCAGCGACGAGGTCCTCTACAGCATTGGCGGCGGCAGTGCGGTGAGCATGGGCAGCGC
CGGCCAGATGGACTCGATCGGCGTCGGCTTCGGCTGGAACAACGACATGATGTGCGGAAACATGAACCTGAGCACCACCC
TGGAGAACCAGCTCAACGGTGCCACACAGGGTTTCCAGAACATCATGGGCTCAGTCATCCAGAACGCGACCGGCGCGGTC
ATGTCGCTGCCGGCGTTGATCATCCAGCGCGCGAACCCTCAGCTCTACAACCTGATCACCAATGGCATCCTGCAGGCGCG
GATCGACTACGACCGCTCGAAAGGGACTTGCAAAACGATCGCCGAAAAGATGGCTGACATCGCTGGCGAGCAGACCGGCT
GGGGGAAAATCGCCGAAGGCCAAGCCCTGGGCGCCACACTGGCCTCTGACGGGAAAGACGCCGTATCCGCCCTCGAAGCA
GTGGAGAAGAAAGGCGGCAACGATGGCGTAACCTGGGTTGGTGGAGACAAGGCCGGCGGCTCCGGCCAGAAGCCCATTCG
CATCGTCAACGACGTGACCCGGGCGGGCTACAACCTGTTGACCAGCCGCTCGGTGAATGATTCGTCGAGCGTGCCTTCCG
CCACTTGCAACAACGGCCTGGTCTGCAACACTTGGTCCTCCCCCAGGAGGCCGCCGCATTCGCCACCCGGGTACTGGGG
GAGCAACAGCAACAGACCTGCGAAGGCTGCCAGAAGACGGTGACGGCTGCTGGCGTCGGCCTCACCCCGCTGATCCAGGA
GACCTACGACAAGAAGCTCCAGTCGCTGCAGGAGCTGCTGTCGAAGAGCAAACCACTGACTGCAGAGAACCTGGCTGCGG
CCGGCACCGATGCTCTGCCAATTACCCGCGGCGTCATCGAGGCGCTGCGCGACGAGCGTGACCAGGACGTCCTGGCGCGC
CGCCTGGCGTCCGATGTCTCCCTGATGGACGTGCTCAGCAAGGCACTGCTACTGCAGCGCCTGATGTTCGCCGGCGCCAA
GGAGCCCAACGTCGCCGCCAACGGCCTGGCCACCCAAGCCGTCGATCAGCAGACCAGCCTCCTGCAGCAGGAGATCTCCA
ATCTCAAGACCGAACTGGAACTCCGTCGCGAGTTGGCCAGCAACTCCCCCATGCGGGTCATCGAGCGCGGGCAACAACGC
GCCTCAGGGTCCAGTGGCGTGTTCGAGTCGGCGCCCGATGCCGATCGCCTCGATCGCCTGCAGGCCCCCTCTGCCGCCGG
CGGCAAGTCGGGAGGGAGACCGTGA

>ORF5899 (SEQ ID NO:52)
TCGGCCATCCTGGTGGCGCCACGTTCAGCCGGTTCGCCAGCGCCTCTGGGTACGTTTGCCCTGGCGCCACCGTCCCGCTG
GTGCCGTACTTTCTCAGCACACTGGACGCCATTGGCTGGCGGCATGGAATTCCCGAGCAGGTGTACCCCGAAGCGTTGGT
CCCAGGGCTGCGCGAGGTGGGTGGAATCTTCTCCGGCGACATGTGGGGGAACCTCTATCCGCGCAGCGGCTTCCTGCACC
AGACCGACGACTACAAGACGGCAGCCGTCATCGCCCAGCGCGCCGGCGATATCACCACGCGAATCGGCCAGCTCCACGTC
TACCTCCCCATGCGCGCAGCCCCCAAGGACGGCTACTGGCCGGCGGGCGAGCTGA

>ORF6325 (SEQ ID NO:54)
GCCTCAACTGCGCGGTGTTTCCCAACTCTGGGCCGAAGACGCAAGCCGTCGACGGGGAGCACGCCTGGGCGCTCTGGCGT
CCCTACTCCTGCTGCCAGCGCAAGGGGCAGATGTTCATCTGCAGTACCGACTTCCAATAAGGACACGGAGACGAATCATG
CGAATGAACATCACCTCGGTCGCGCTAATGTGGCTGCTCGCAGCGCAACTTGCCCAGGCCGACGACCCGATCAACGTGTC
CAAGACCGGCACGGTGCTCAGCGACGAGGTCCTCTACAGCATTGGCGGCGGCAGTGCGGTGAGCATGGGCAGCGCCGGCC
AGATGGACTCGATCGGCGTCGGCTTCGGCTGGAACAACGACATGATGTGCGGAAACATGAACCTGAGCACCACCCTGGAG
AACCAGCTCAACGGTGCCACACAGGGTTTCCAGAACATCATGGGCTCAGTCATCCAGAACGCGACCGGCGCGGTCATGTC
GCTGCCGGCGTTGATCATCCAGCGCGCGAACCCTCAGCTCTACAACCTGATCACCAATGGCATCCTGCAGGCGCGGATCG
ACTACGACCGCTCGAAAGGGACTTGCAAAACGATCGCCGAAAAGATGGCTGA

Fig. 3-7

>ORF7567c (SEQ ID NO:56)
CAGTGCCTTGCTGAGCACGTCCATCAGGGAGACATCGGACGCCAGGCGGCGCGCCAGGACGTCCTGGTCACGCTCGTCGC
GCAGCGCCTCGATGACGCCGCGGGTAATTGGCAGAGCATCGGTGCCGGCCGCAGCCAGGTTCTCTGCAGTCAGTGGTTTG
CTCTTCGACAGCAGCTCCTGCAGCGACTGGAGCTTCTTGTCGTAGGTCTCCTGGATCAGCGGGGTGAGGCCGACGCCAGC
AGCCGTCACCGTCTTCTGGCAGCCTTCGCAGGTCTGTTGCTGTTGCTCCCCCAGTACCCGGGTGGCGAATGCGGCGGCCT
CCTGGGGGGAGGACCAAGTGTTGCAGACCAGGCCGTTGTTGCAAGTGGCGGAAGGCACGCTCGACGAATCATTCACCGAG
CGGCTGGTCAACAGGTTGTAGCCCGCCCGGGTCACGTCGTTGACGATGCGAATGGGCTTCTGGCCGGAGCCGCCGGCCTT
GTCTCCACCAACCCAGGTTACGCCATCGTTGCCGCCTTTCTTCTCCACTGCTTCGAGGGCGGATACGGCGTCTTTCCCGT
CAGAGGCCAGTGTGGCGCCCAGGGCTTGGCCTTCGGCGATTTTCCCCCAGCCGGTCTGCTCGCCAGCGATGTCAGCCATC
TTTTCGGCGATCGTTTTGCAAGTCCCTTTCGAGCGGTCGTAGTCGATCCGCGCCTGCAGGATGCCATTGGTGATCAGGTT
GTAGAGCTGAGGGTTCGCGCGCTGGATGATCAACGCCGGCAGCGACATGACCGCGCCGGTCGCGTTCTGGATGACTGA

>ORF7180 (SEQ ID NO:58)
TTCGTCGAGCGTGCCTTCCGCCACTTGCAACAACGGCCTGGTCTGCAACACTTGGTCCTCCCCCCAGGAGGCCGCCGCAT
TCGCCACCCGGGTACTGGGGGAGCAACAGCAACAGACCTGCGAAGGCTGCCAGAAGACGGTGACGGCTGCTGGCGTCGGC
CTCACCCCGCTGATCCAGGAGACCTACGACAAGAAGCTCCAGTCGCTGCAGGAGCTGCTGTCGAAGAGCAAACCACTGAC
TGCAGAGAACCTGGCTGCGGCCGGCACCGATGCTCTGCCAATTACCCGCGGCGTCATCGAGGCGCTGCGCGACGAGCGTG
A

>ORF7501 (SEQ ID NO:60)
CCAGGACGTCCTGGCGCGCCGCCTGGCGTCCGATGTCTCCCTGATGGACGTGCTCAGCAAGGCACTGCTACTGCAGCGCC
TGATGTTCGCCGGCGCCAAGGAGCCCAACGTCGCCGCCAACGGCCTGGCCACCCAAGCCGTCGATCAGCAGACCAGCCTC
CTGCAGCAGGAGATCTCCAATCTCAAGACCGAACTGGAACTCCGTCGCGAGTTGGCCAGCAACTCCCCCATGCGGGTCAT
CGAGCGCGGGCAACAACGCGCCTCAGGGTCCAGTGGCGTGTTCGAGTCGGCGCCCGATGCCGATCGCCTCGATCGCCTGC
AGGCCCCCTCTGCCGCCGGCGGCAAGTCGGGAGGGAGACCGTGATGGCAGATACGCTCACCACCCGAAAGCTTCTCGGTC
AGCTACTGGTCGGAGTGCTGATCGTCATCGGACTGGCAGTGGTCGGTACGCTGCTCAGTCTCTTCGCCCTGAACCACTTC
GGTGGCATCCAGGGCCTGGAGGCCTGGCGGCAAAGCAACTACTGGAGCTTGTTCGCCTGGCGGGCGCTGCTGTACTGCGC
CCTGGCCATCGCCTGGTTCCGGCAGCGCAAGGAACTGAGCGCGCATGAGCGGCAGCGCATTCGGCGGATCGAGATCCTGG
TGCTGTTGCTGGTCCTGCTCATCGAATTCAGCAAAGCCTACTTCCGCACGGGAGGCGCAGCATGA

>ORF7584 (SEQ ID NO:62)
TGTTCGCCGGCGCCAAGGAGCCCAACGTCGCCGCCAACGGCCTGGCCACCCAAGCCGTCGATCAGCAGACCAGCCTCCTG
CAGCAGGAGATCTCCAATCTCAAGACCGAACTGGAACTCCGTCGCGAGTTGGCCAGCAACTCCCCCATGCGGGTCATCGA
GCGCGGGCAACAACGCGCCTCAGGGTCCAGTGGCGTGTTCGAGTCGGCGCCCGATGCCGATCGCCTCGATCGCCTGCAGG
CCCCCTCTGCCGCCGGCGGCAAGTCGGGAGGGAGACCGTGATGGCAGATACGCTCACCACCCGAAAGCTTCTCGGTCAGC
TACTGGTCGGAGTGCTGATCGTCATCGGACTGGCAGTGGTCGGTACGCTGCTCAGTCTCTTCGCCCTGAACCACTTCGGT
GGCATCCAGGGCCTGGAGGCCTGGCGGCAAAGCAACTACTGGAGCTTGTTCGCCTGGCGGGCGCTGCTGTACTGCGCCCT
GGCCATCGCCTGGTTCCGGCAGCGCAAGGAACTGAGCGCGCATGA

>ORF8208c (SEQ ID NO:64)
AGGTCATGCTGCGCCTCCCGTGCGGAAGTAGGCTTTGCTGAATTCGATGAGCAGGACCAGCAACAGCACCAGGATCTCGA
TCCGCCGAATGCGCTGCCGCTCATGCGCGCTCAGTTCCTTGCGCTGCCGGAACCAGGCGATGGCCAGGGCGCAGTACAGC
AGCGCCCGCCAGGCGAACAAGCTCCAGTAGTTGCTTTGCCGCCAGGCCTCCAGGCCCTGGATGCCACCGAAGTGGTTCAG
GGCGAAGAGACTGAGCAGCGTACCGACCACTGCCAGTCCGATGACGATCAGCACTCCGACCAGTAG

Fig. 3-8

>ORF8109 (SEQ ID NO:66)
GCGGCAGCGCATTCGGCGGATCGAGATCCTGGTGCTGTTGCTGGTCCTGCTCATCGAATTCAGCAAAGCCTACTTCCGCA
CGGGAGGCGCAGCATGACCTTCATGACCAATGACTACCTGGAGTATTACCTCACCCTCCTCGGCTGGATCATCAACAACG
GGATCTGGAACATGATCTCGGATACTGGCCTGTTCGCGGTGCCGTTCGCGGCCATCGTGATGCGCGAATGGCTGAAAGTT
CGTGGGGAAGGCGCCGACGAGGGCAACAAGGGAGTGCTGTCTCTCGCCCGCATCGAGACGCATATCTACGTCGGCTACAT
CGTGGTCGCCCTGGCGGGGATCCCGGTCGTCAACGTGAGCTTCGACACCATCGAGTTCGACCAGACTCGCGCCCAGCAGT
GCCAATACAATCTGCCGGCACCGGCGGACACCGGCTGGTCGAGCTCCTTCAGCAGCCTGGCCGGCAAGAGTGCGCAGATG
CCGCTCTGGTGGGCGATGATGCACGCCCTGTCCAAGGGCTTCACCAGCGGCGCCATCGCGGCCATTCCGTGCGGCACGGA
TCTGCGGCAGATGCGAATGGAAGTGGACAACACGCGCGTGAACAATCCGCTGCTGGCACAAGAAATCGCTGATTTTTCCA
GAGACTGCTACGGGCCTTCCCGTGCGCGGCTGTTCATGCGGCAACCCGACCTGGGCTCCGTCGCCGAGGACAACAAGGCG
TTGCAAGACCTGAACTGGATCGGCTCCCGATTCTTGTTGAACACCCCGGGGTACTACGACACCGACTACTCGAAGAGTCC
CCGTCAGTCGTGGCCCTACAACGCCACCCGCGATGCCGGCCTGCCTCAGGTGGGCGGTGGTGGCGGCTACCCAACCTGCA
AGCAGTGGTGGGCTGACTCAGGGATCGGCTTGCGTGATCGGATCAAGGACCAGGTGGATCCGGACCTGATGACCAGCTTC
CTCAAGTGGGCGAAATGGTTGAACCAGGACGAGGTGACCGAGGCTGTCATTCGCCAGGTGATCTCACCCTCCAGCCAGGT
CAAGGGTAACGTCTACACCGATTACGGCGGGCAGGTGGGCGGCACCGTGTGGAACGGCATCGCGAGAACCGCAGGAACCT
TCGGCGTTGCGGTGGGCAGCTTGGCATACTTCCCGGCGATGGATATGGTCCGCCAGGCACTGCCGATGGTGATGTCGTTC
CTGAAGATGGCAATGGTCATCTGCATTCCGATGGTCCTGGTCATCGGCACCTATCAACTGAAAGTTGCCATGACGATGAC
GGTCGTCTTCTTTGCGATGATGTTCGTCGACTTCTGGTTTCAGTTAGCCAGATATATCGACAGCACGATACTTGATGCTT
TCTATGGTTCGGGATCACCACATCTTTCATTCAACCCAGTCATGGGGCTGAATACGGCTACTCAAGATGCGATCTTGAAC
TTCGTTATGGGTTCTATGTTCATTGTTTTACCACTACTGTGGATGACAGCGATCGGCTGGTCCGGAATTCAAGCAGGGTC
TGTTCTGAACGGATTGAGCAGAGGGACTGAAGGAGTTCAAGCCGCCGGCAAGGAAGCAGGAAATAGAGTTAAAAACGCAG
TTTGA

>ORF9005c (SEQ ID NO:68)
GTCAGCCCACCACTGCTTGCAGGTTGGGTAGCCGCCACCACCGCCCACCTGAGGCAGGCCGGCATCGCGGGTGGCGTTGT
AGGGCCACGACTGACGGGGACTCTTCGAGTAGTCGGTGTCGTAGTACCCCGGGGTGTTCAACAAGAATCGGGAGCCGATC
CAGTTCAGGTCTTGCAACGCCTTGTTGTCCTCGGCGACGGAGCCCAGGTCGGGTTGCCGCATGAACAGCCGCGCACGGGA
AGGCCCGTAGCAGTCTCTGGAAAAATCAGCGATTTCTTGTGCCAGCAGCGGATTGTTCACGCGCGTGTTGTCCACTTCCA
TTCGCATCTGCCGCAGATCCGTGCCGCACGGAATGGCCGCGATGGCGCCGCTGGTGAAGCCCTTGGACAGGGCGTGCATC
ATCGCCCACCAGAGCGGCATCTGCGCACTCTTGCCGGCCAGGCTGCTGAAGGAGCTCGACCAGCCGGTGTCCGCCGGTGC
CGGCAGATTGTATTGGCACTGCTGGGCGCGAGTCTGGTCGAACTCGATGGTGTCGAAGCTCACGTTGACGACCGGGATCC
CCGCCAGGGCGACCACGATGTAGCCGACGTAGATATGCGTCTCGATGCGGGCGAGAGACAGCACTCCCTTGTTGCCCTCG
TCGGCGCCTTCCCCACGAACTTTCAGCCATTCGCGCATCACGATGGCCGCGAACGGCACCGCGAACAGGCCAGTATCCGA
GATCATGTTCCAGATCCCGTTGTTGATGATCCAGCCGAGGAGGGTGAGGTAATACTCCAGGTAGTCATTGGTCATGAAGG
TCATGCTGCGCCTCCCGTGCGGAAGTAG

>ORF8222 (SEQ ID NO:70)
CTACCTGGAGTATTACCTCACCCTCCTCGGCTGGATCATCAACAACGGGATCTGGAACATGATCTCGGATACTGGCCTGT
TCGCGGTGCCGTTCGCGGCCATCGTGATGCGCGAATGGCTGAAAGTTCGTGGGGAAGGCGCCGACGAGGGCAACAAGGGA
GTGCTGTCTCTCGCCCGCATCGAGACGCATATCTACGTCGGCTACATCGTGGTCGCCCTGGCGGGGATCCCGGTCGTCAA
CGTGAGCTTCGACACCATCGAGTTCGACCAGACTCGCGCCCAGCAGTGCCAATACAATCTGCCGGCACCGGCGGACACCG
GCTGGTCGAGCTCCTTCAGCAGCCTGGCCGGCAAGAGTGCGCAGATGCCGCTCTGGTGGGCGATGATGCACGCCCTGTCC
AAGGGCTTCACCAGCGGCGCCATCGCGGCCATTCCGTGCGGCACGGATCTGCGGCAGATGCGAATGGAAGTGGACAACAC
GCGCGTGAACAATCCGCTGCTGGCACAAGAAATCGCTGA

>ORF8755c (SEQ ID NO:72)
CAGTCTCTGGAAAAATCAGCGATTTCTTGTGCCAGCAGCGGATTGTTCACGCGCGTGTTGTCCACTTCCATTCGCATCTG
CCGCAGATCCGTGCCGCACGGAATGGCCGCGATGGCGCCGCTGGTGAAGCCCTTGGACAGGGCGTGCATCATCGCCCACC
AGAGCGGCATCTGCGCACTCTTGCCGGCCAGGCTGCTGAAGGAGCTCGACCAGCCGGTGTCCGCCGGTGCCGGCAGATTG
TATTGGCACTGCTGGGCGCGAGTCTGGTCGAACTCGATGGTGTCGAAGCTCACGTTGACGACCGGGATCCCCGCCAGGGC
GACCACGATGTAG

Fig. 3-9

>ORF9431c (SEQ ID NO:74)
CTGAAACCAGAAGTCGACGAACATCATCGCAAAGAAGACGACCGTCATCGTCATGGCAACTTTCAGTTGATAGGTGCCGA
TGACCAGGACCATCGGAATGCAGATGACCATTGCCATCTTCAGGAACGACATCACCATCGGCAGTGCCTGGCGGACCATA
TCCATCGCCGGGAAGTATGCCAAGCTGCCCACCGCAACGCCGAAGGTTCCTGCGGTTCTCGCGATGCCGTTCCACACGGT
GCCGCCCACCTGCCCGCCGTAATCGGTGTAGACGTTACCCTTGACCTGGCTGGAGGGTGA

>ORF9158 (SEQ ID NO:76)
CGTCTACACCGATTACGGCGGGCAGGTGGGCGGCACCGTGTGGAACGGCATCGCGAGAACCGCAGGAACCTTCGGCGTTG
CGGTGGGCAGCTTGGCATACTTCCCGGCGATGGATATGGTCCGCCAGGCACTGCCGATGGTGATGTCGTTCCTGAAGATG
GCAATGGTCATCTGCATTCCGATGGTCCTGGTCATCGGCACCTATCAACTGAAAGTTGCCATGACGATGACGGTCGTCTT
CTTTGCGATGATGTTCGTCGACTTCTGGTTTCAGTTAGCCAGATATATCGACAGCACGATACTTGA

>ORF10125c (SEQ ID NO:78)
GTGATAGCAGGATGCCTCCCTTTGGGAGCCAGGAGATTGATGATGAACGCGCACACCAACAAAGGCTTTGCCTCCCGGAT
CGGTTTTGGTCTGGGTATGCTTGTGCGTTTCTGCCTGCATGATCGCCGTCCAGCTCTACGTTGGGTTAAGCGAGTTAGCC
TATTCTTGTTAGTAGCTCTTGTAGTGTCACAGAATTTTATGTGGCTTGCTGGGGTATCAATGACTCTACTGTGTGTCTTT
CTGGTGGGATTTGCCTTGGTTAAAGGGGACATCTCCGTCTCTAAAGGGTCTCCAAGTCGAGATGTCTCAACTATGACTTC
ACAAGCTGAAACTGAATCTGTAGCAGAGCTGTTTGACTATCAGGCAGCACACCATTACCGGGACTAG

>ORF9770 (SEQ ID NO:80)
TCAAACAGCTCTGCTACAGATTCAGTTTCAGCTTGTGAAGTCATAGTTGAGACATCTCGACTTGGAGACCCTTTAGAGAC
GGAGATGTCCCCTTTAACCAAGGCAAATCCCACCAGAAAGACACACAGTAGAGTCATTGATACCCCAGCAAGCCACATAA
AATTCTGTGACACTACAAGAGCTACTAACAAGAATAGGCTAACTCGCTTAACCCAACGTAGAGCTGGACGGCGATCATGC
AGGCAGAAACGCACAAGCATACCCAGACCAAAACCGATCCGGGAGGCAAAGCCTTTGTTGGTGTGCGCGTTCATCATCAA
TCTCCTGGCTCCCAAAGGGAGGCATCCTGCTATCACCTATACGCCGAAAAAGATGATTTGGCAAGCATTATGGCATATTA
TGCCACTAGCTATCTGCCGACTGGAGTACCTCATGGCAACGCGAAACGTCGTCCTTCCCGATCCGCTGGAGCAGGATATC
AACGAGCTGGTGGAGACCGGCCGCTATCAGAATCGCAGCGAAGTCATCCGGGCAGGCTTGCGCCTGCTGCTGCAACAGGA
AGCCCAGATANGCGCCAAGCTCGAAACCCTCCGCAACGCAACATCCAGTGGGCTGATGCAACTGGAGCGCGGCGAGTACG
ACGAGATCACCAGCGACGAACTGGCCCAATACCTCGACGAGCTCGGCAACCAGGCGAGCCACTGA

>ORF9991 (SEQ ID NO:82)
AGCTGGACGGCGATCATGCAGGCAGAAACGCACAAGCATACCCAGACCAAAACCGATCCGGGAGGCAAAGCCTTTGTTGG
TGTGCGCGTTCATCATCAATCTCCTGGCTCCCAAAGGGAGGCATCCTGCTATCACCTATACGCCGAAAAAGATGATTTGG
CAAGCATTATGGCATATTATGCCACTAGCTATCTGCCGACTGGAGTACCTCATGGCAACGCGAAACGTCGTCCTTCCCGA
TCCGCTGGAGCAGGATATCAACGAGCTGGTGGAGACCGGCCGCTATCAGAATCGCAGCGAAGTCATCCGGGCAGGCTTGC
GCCTGCTGCTGCAACAGGAAGCCCAGATANGCGCCAAGCTCGAAACCCTCCGCAACGCAACATCCAGTGGGCTGATGCAA
CTGGAGCGCGGCGAGTACGACGAGATCACCAGCGACGAACTGGCCCAATACCTCGACGAGCTCGGCAACCAGGCGAGCCA
CTGAAGCATGGCCAAGTACCGCATCTCTCATGA

>ORF10765c (SEQ ID NO:84)
CACCTGGTCTGTCGCCACCCGGTAGAAGACGAAGTGCCTGGGCCGAACAACCTTACCGACATTGGGCATCGAGTGGCAGT
AAACGAGGTGGATGCTGCGCAGGCCAGCTCCCAGTTCTTCACGGCTGATGCTGCCTACCTGTTGTGGGTCTGTCGCAACT
GCTTCCAGCGCCGCCCCTATGAGTGCCTGGTAACGTCGGCGCGCGGCATCGCCGAAGTGGTTGTGGGTGAAGCGCAGGAT
ATCGACGATGTCCGCTTGGGCATCATGAGAGATGCGGTACTTGGCCATGCTTCAGTGGCTCGCCTGGTTGCCGAGCTCGT
CGAGGTATTGGGCCAGTTCGTCGCTGGTGATCTCGTCGTACTCGCCGCGCTCCAGTTGCATCAGCCCACTGGATGTTGCG
TTGCGGAGGGTTTCGAGCTTGGCGCNTATCTGGGCTTCCTGTTGCAGCAGCAGGCGCAAGCCTGCCCGGATGACTTCGCT
GCGATTCTGATAGCGGCCGGTCTCCACCAGCTCGTTGATATCCTGCTCCAGCGGATCGGGAAGGACGACGTTTCGCGTTG
CCATGAGGTACTCCAGTCGGCAGATAGCTAG

Fig. 3-10

>ORF10475 (SEQ ID NO:86)
AGCATGGCCAAGTACCGCATCTCTCATGATGCCCAAGCGGACATCGTCGATATCCTGCGCTTCACCCACAACCACTTCGG
CGATGCCGCGCGCCGACGTTACCAGGCACTCATAGGGGCGGCGCTGGAAGCAGTTGCGACAGACCCACAACAGGTAGGCA
GCATCAGCCGTGAAGAACTGGGAGCTGGCCTGCGCAGCATCCACCTCGTTTACTGCCACTCGATGCCCAATGTCGGTAAG
GTTGTTCGGCCCAGGCACTTCGTCTTCTACCGGGTGGCGACAGACCAGGTGCTAGAGGTGGTTCGCGTGCTTCACGACGC
CATGGATGTGGATCAACACCTGCCCCAACGATGA

>ORF11095c (SEQ ID NO:88)
AGCCGCATGCAAGCGGTGGTCAGCACGAATGCAAATGCTTGGTCAGGGGGAATGCAATCGAGTGGTCAAGCCACTGCTAT
TGCGCATCAACCATGGGGCACCTGCTGGTGGATGTTCACCCGTAGCCTTTTCGTGTTCGCCGGCGCGAACGCAGCCCTTT
CTGCCTTCCGGCAGGCCCTTTCGGGTAGGGCTTTTACCCTTGTGAACCATTCCCTTCGCCCTTCAAGCCCATTTCCCCTT
TGGGCCATTTGCTCCTGTTACAGTTGCTCATCGTTGGGGCAGGTGTTGATCCACATCCATGGCGTCGTGAAGCACGCGAA
CCACCTCTAG

>ORF11264 (SEQ ID NO:90)
ACCGCGGTGCGGAGAGATCTCCTCAAACTGATGGGTTGCACGCATATCGAAGCAGATTACATAGGAGGCTTGCGCTGTTC
AACAGCTCCTGAGGGGACTTGGGTTGCCCATGGTTTCCACGGCCCAATCGTTGACGTCATTGACGATTCCGCTGGCTTTT
TCAGTACGCATCGCTTGGCGCTCCATTACCCAGCCCAATGCGGCCTTGCCGTTGACCAAGCGATTCCAAGGACTGCGATC
CATGTAGCCAGCCCTCTAATGCATGTATGTATAGGTAAGGTCGTCGTTATTTCGGCGTGGATGTGCTGA

>ORF11738 (SEQ ID NO:92)
GAAGAGGTGATCATGAAGTTACAGGCATATCGGCTGCAGAACTACCGCCGGCTGCGCGATGTTGTCATCGAGCTCGATGA
CGAAATTTCTATCTTTGTCGGTGCCAACAACAGCGGGAAGACATCCGCCGTCCAAGGCCTGTACTCAATGCTTCGCGGCG
AAGTGAAGAAGTTCGAGCTCTTTGACTTCAGTGCGGCGCTGTGGGCCGAGATCGATGCGGTCGGCAGGACGCCCCCTGGC
GATGAGGATGCGCCCAAAAGGTTACCGTCCATACTCTTGGATCTCTGGTTCCGCGTCGGTGAAGACGACCTCGCCACTGC
GATGTCGCTGCTGCCGAGCACTGAGTGGGACGGCAAGTGCGTCGGGATCCGGGTAGCGTTCGAGCCTCGGGATGCCCACG
AGCTCGTCTGGAAGTTCCATGAACTACATGAGAAGGCCAACAACGCAGCTGTCGCGCTTGCGGCCAAGCGCAAGGCCGCC
GGGGAGCAAGCTGTGGAGGCGGGCGCGGAAGACGCGGCTGCGGTGGTGGCCGATGCCGGCGAGTACAAGCCTTGGCCAGA
AAGCCTGACGAAGTACCTCACAAAGGAACTGAGCAAGGAATACACCTTCCGCTACTACGTGCTCGATGAGCGGGCTTTTG
TCGGCTATCAGGCAAGGGAGGCCGACTACGAGCCGCTACCCCTAGGCAAGGAGCCGGGCGGTGCAGCCATTCTCAAGTCG
CTGGTGAGGGTCGACTTCCTGCGCGCGCAGCGGCACCTCGATGACCCAGATGCCGGTAGCTCTGATCGCGCAGAGAGCTT
GTCGCGGCGTCTGAGCAGGTTCTATCACCGCAACCTGGAGAAGCGTGGCGACGACCATGCGGCTCTCAAGGCGCTAGATA
CCTCGGAGAAGGAGCTGAACTTCCACCTGAAGGAAGTCTTCAATGACACCCTCACGCGCCTGGCCAAGCTCGGCTATCCG
GGCGTCAACAATCCGGAGATCGTGATTCGGGCGGCCTTGGATCCGACCACTGTCTTGGGGCAAGACGCCAAGGTTCACTA
CGTGATCCCGGGCGTAGCTTCCGCCCAACTGCCAGACAGCTACAATGGCCTGGGGTTCAAGAATCTGGTCTACATGGTGG
TTGAGCTGCTCGACTTGCACGAGCAGTGGAAAGCCGAGGATGACAAGCGAGCTCCGCTTCATTTGGTCTTCATTGAGGAG
CCTGAGGCGCATCTGCACGCGCAGATCCAGCAGGTCTTCATCAGGAACGTTTTGCGCCTCCTTGAGGATGCTAACGATCA
CGCGACTTTGTTCCACACGCAGCTCGTCATCACCACGCACTCCCCGCACATCCTCTATGAACGCGGATTCTCGCCCATTC
GGTACTTCCGCCGCGTCAACGACCAGTTGGGCCATCACACGGATGTGCGCAATCTGTCGCTATTCAAAACGGGCGCGTCC
GACGCTCCAGCGCGCGAATTCCTGCAGCGGTATCTGAAGCTGACGCACTGCGATCTCTTTTTTTTCCGACGCGGTGATATT
GGTGGAAGGCAACGTCGAGCGTCTGCTCCTGCCTGCAATGATCGAGTTGGTGGCCAAGCGCCTGCGTTCTTCCGCCCTAA
CCATCCTTGAAGTCGGTGGTGCGTTCGCGCATCGGTTCCAGGAGCTGATCGCCTTCGTTGGGCTCACAACACTGGTCATC
ACGGATCTGGACAGCGTGACGGTCAAGACGGACGCCGAGAAGGCCGCCGCGCAAGGCGCAGGCGCTGAGGGCGCCGTTGA
CGGAGATGACGAGGACGAGGACGACGACCTGAAGCCCTTCGAGCTTGAAGACGACGACGAAGCAGAACCGAGTGGCAAGA
AGAAGTCCAAGAAGCGTGGCAGCACCTGCCATGCACACGTGGAAGGTGCCGTCACGTCCAACCAAACCCTCATCAGCTGG
ATCCCGAAGAAGCGGTCGATGGCAGAGCTCTGGGAAGTCACGGCGGAGCAAAAGACGCTGTCGCTGGCTGAGGATTCCAG
CGCTGGGGTTCGGGTAGCTTACCAGACCAAGGTTTCGGTGACGGTGGGTGCGACGACATCACAGCTCTGCGGCCGCACAC
TTGAGGAGGCCTTTGGTCTTGAGAACGCGGACTGGTGCCAGGCTGAGGCAAACCGGTCGGTCGGCCTCAAGCTCAAGCGC
GCACCGAGCAGCCCTGAAGAGCTGGCTGAGAAGTTACACGATAGGGTGGTCGGCAAGAACTTCGACAAGACCCGCTTTGC
GCTGGAGGTACTCGCAAGCGGGCCGCTCAATGGCTGGAAGGTTCCCGCGTACATCGCCGAGGGCTTGGCCTGGCTCGAAG
CCAAAGTGGCCCACGAGCTTGAGGCGGATGCTGCCATCGCCACCGAGGTCGCGACTATTGAGCCGACTACAGCCGATGTT
GTCGCTATCATTGTTGACCCGGGGCAGACGGCATGA

Fig. 3-11

>ORF12348c (SEQ ID NO:94)
CGGAAGGTGTATTCCTTGCTCAGTTCCTTTGTGAGGTACTTCGTCAGGCTTTCTGGCCAAGGCTTGTACTCGCCGGCATC
GGCCACCACCGCAGCCGCGTCTTCCGCGCCCGCCTCCACAGCTTGCTCCCCGGCGGCCTTGCGCTTGGCCGCAAGCGCGA
CAGCTGCGTTGTTGGCCTTCTCATGTAGTTCATGGAACTTCCAGACGAGCTCGTGGGCATCCCGAGGCTCGAACGCTACC
CGGATCCCGACGCACTTGCCGTCCCACTCAGTGCTCGGCAGCAGCGACATCGCAGTGGCGAGGTCGTCTTCACCGACGCG
GAACCAGAGATCCAAGAGTATGGACGGTAACCTTTTGGGCGCATCCTCATCGCCAGGGGCGTCCTGCCGACCGCATCGA
TCTCGGCCCACAGCGCCGCACTGAAGTCAAAGAGCTCGAACTTCTTCACTTCGCCGCGAAGCATTGAGTACAGGCCTTGG
ACGGCGGATGTCTTCCCGCTGTTGTTGGCACCGACAAAGATAGAAATTTCGTCATCGAGCTCGATGACAACATCGCGCAG
CCGGCGGTAG

>ORF12314c (SEQ ID NO:96)
GGTACTTCGTCAGGCTTTCTGGCCAAGGCTTGTACTCGCCGGCATCGGCCACCACCGCAGCCGCGTCTTCCGCGCCCGCC
TCCACAGCTTGCTCCCCGGCGGCCTTGCGCTTGGCCGCAAGCGCGACAGCTGCGTTGTTGGCCTTCTCATGTAGTTCATG
GAACTTCCAGACGAGCTCGTGGGCATCCCGAGGCTCGAACGCTACCCGGATCCCGACGCACTTGCCGTCCCACTCAGTGC
TCGGCAGCAGCGACATCGCAGTGGCGAGGTCGTCTTCACCGACGCGGAACCAGAGATCCAAGAGTATGGACGGTAACCTT
TTGGGCGCATCCTCATCGCCAGGGGCGTCCTGCCGACCGCATCGATCTCGGCCCACAGCGCCGCACTGA

>ORF13156c (SEQ ID NO:98)
CGACAGATTGCGCACATCCGTGTGATGGCCCAACTGGTCGTTGACGCGGCGGAAGTACCGAATGGGCGAGAATCCGCGTT
CATAGAGGATGTGCGGGGAGTGCGTGGTGATGACGAGCTGCGTGTGGAACAAAGTCGCGTGATCGTTAGCATCCTCAAGG
AGGCGCAAAACGTTCCTGATGAAGACCTGCTGGATCTGCGCGTGCAGATGCGCCTCAGGCTCCTCAATGAAGACCAAATG
AAGCGGAGCTCGCTTGTCATCCTCGGCTTTCCACTGCTCGTGCAAGTCGAGCAGCTCAACCACCATGTAGACCAGATTCT
TGAACCCCAGGCCATTGTAGCTGTCTGGCAGTTGGGCGGAAGCTACGCCCGGGATCACGTAGTGAACCTTGGCGTCTTGC
CCAAGACAGTGGTCGGATCCAAGGCCGCCCGAATCACGATCTCCGGATTGTTGACGCCCGGATAGCCGAGCTTGGCCAG
GCGCGTGAGGGTGTCATTGAAGACTTCCTTCAGGTGGAAGTTCAGCTCCTTCTCCGAGGTATCTAG

>ORF12795 (SEQ ID NO:100)
CTTCCGCCCAACTGCCAGACAGCTACAATGGCCTGGGGTTCAAGAATCTGGTCTACATGGTGGTTGAGCTGCTCGACTTG
CACGAGCAGTGGAAAGCCGAGGATGACAAGCGAGCTCCGCTTCATTTGGTCTTCATTGAGGAGCCTGAGGCGCATCTGCA
CGCGCAGATCCAGCAGGTCTTCATCAGGAACGTTTTGCGCCTCCTTGAGGATGCTAACGATCACGCGACTTTGTTCCACA
CGCAGCTCGTCATCACCACGCACTCCCCGCACATCCTCTATGAACGCGGATTCTCGCCCATTCGGTACTTCCGCCGCGTC
AACGACCAGTTGGGCCATCACACGGATGTGCGCAATCTGTCGCTATTCAAAACGGGCGCGTCCGACGCTCCAGCGCGCGA
ATTCCTGCAGCGGTATCTGA

>ORF12314c (SEQ ID NO:96)
GGTACTTCGTCAGGCTTTCTGGCCAAGGCTTGTACTCGCCGGCATCGGCCACCACCGCAGCCGCGTCTTCCGCGCCCGCC
TCCACAGCTTGCTCCCCGGCGGCCTTGCGCTTGGCCGCAAGCGCGACAGCTGCGTTGTTGGCCTTCTCATGTAGTTCATG
GAACTTCCAGACGAGCTCGTGGGCATCCCGAGGCTCGAACGCTACCCGGATCCCGACGCACTTGCCGTCCCACTCAGTGC
TCGGCAGCAGCGACATCGCAGTGGCGAGGTCGTCTTCACCGACGCGGAACCAGAGATCCAAGAGTATGGACGGTAACCTT
TTGGGCGCATCCTCATCGCCAGGGGCGTCCTGCCGACCGCATCGATCTCGGCCCACAGCGCCGCACTGA

>ORF13156c (SEQ ID NO:98)
CGACAGATTGCGCACATCCGTGTGATGGCCCAACTGGTCGTTGACGCGGCGGAAGTACCGAATGGGCGAGAATCCGCGTT
CATAGAGGATGTGCGGGGAGTGCGTGGTGATGACGAGCTGCGTGTGGAACAAAGTCGCGTGATCGTTAGCATCCTCAAGG
AGGCGCAAAACGTTCCTGATGAAGACCTGCTGGATCTGCGCGTGCAGATGCGCCTCAGGCTCCTCAATGAAGACCAAATG
AAGCGGAGCTCGCTTGTCATCCTCGGCTTTCCACTGCTCGTGCAAGTCGAGCAGCTCAACCACCATGTAGACCAGATTCT
TGAACCCCAGGCCATTGTAGCTGTCTGGCAGTTGGGCGGAAGCTACGCCCGGGATCACGTAGTGAACCTTGGCGTCTTGC
CCAAGACAGTGGTCGGATCCAAGGCCGCCCGAATCACGATCTCCGGATTGTTGACGCCCGGATAGCCGAGCTTGGCCAG
GCGCGTGAGGGTGTCATTGAAGACTTCCTTCAGGTGGAAGTTCAGCTCCTTCTCCGAGGTATCTAG

Fig. 3-12

>ORF12795 (SEQ ID NO:100)
CTTCCGCCCAACTGCCAGACAGCTACAATGGCCTGGGGTTCAAGAATCTGGTCTACATGGTGGTTGAGCTGCTCGACTTG
CACGAGCAGTGGAAAGCCGAGGATGACAAGCGAGCTCCGCTTCATTTGGTCTTCATTGAGGAGCCTGAGGCGCATCTGCA
CGCGCAGATCCAGCAGGTCTTCATCAGGAACGTTTTGCGCCTCCTTGAGGATGCTAACGATCACGCGACTTTGTTCCACA
CGCAGCTCGTCATCACCACGCACTCCCCGCACATCCTCTATGAACGCGGATTCTCGCCCATTCGGTACTTCCGCCGCGTC
AACGACCAGTTGGGCCATCACACGGATGTGCGCAATCTGTCGCTATTCAAAACGGGCGCGTCCGACGCTCCAGCGCGCGA
ATTCCTGCAGCGGTATCTGA

>ORF13755c (SEQ ID NO:210)
GCTACCCGAACCCCAGCGCTGGAATCCTCAGCCAGCGACAGCGTCTTTTGCTCCGCCGTGACTTCCCAGAGCTCTGCCAT
CGACCGCTTCTTCGGGATCCAGCTGATGAGGGTTTGGTTGGACGTGACGGCACCTTCCACGTGTGCATGGCAGGTGCTGC
CACGCTTCTTGGACTTCTTCTTGCCACTCGGTTCTGCTTCGTCGTCGTCTTCAAGCTCGAAGGGCTTCAGGTCGTCGTCC
TCGTCCTCGTCATCTCCGTCAACGGCGCCCTCAGCGCCTGCGCCTTGCGCGGCGGCCTTCTCGGCGTCCGTCTTGACCGT
CACGCTGTCCAGATCCGTGATGACCAGTGTTGTGAGCCCAACGAAGGCGATCAGCTCCTGGAACCGATGCGCGAACGCAC
CACCGACTTCAAGGATGGTTAGGGCGGAAGAACGCAGGCGCTTGGCCACCAACTCGATCATTGCAGGCAGGAGCAGACGC
TCGACGTTGCCTTCCACCAATATCACCGCGTCGGAAAAAAGAGATCGCAGTGCGTCAGCTTCAGATACCGCTGCAGGAA
TTCGCGCGCTGGAGCGTCGGACGCGCCCGTTTTGAATAGCGACAGATTGCGCACATCCGTGTGA

>ORF13795c (SEQ ID NO:212)
TGTCGTCGCACCCACCGTCACCGAAACCTTGGTCTGGTAAGCTACCCGAACCCCAGCGCTGGAATCCTCAGCCAGCGACA
GCGTCTTTTGCTCCGCCGTGACTTCCCAGAGCTCTGCCATCGACCGCTTCTTCGGGATCCAGCTGATGAGGGTTTGGTTG
GACGTGACGGCACCTTCCACGTGTGCATGGCAGGTGCTGCCACGCTTCTTGGACTTCTTCTTGCCACTCGGTTCTGCTTC
GTCGTCGTCTTCAAGCTCGAAGGGCTTCAGGTCGTCGTCCTCGTCCTCGTCATCTCCGTCAACGGCGCCCTCAGCGCCTG
CGCCTTGCGCGGCGGCCTTCTCGGCGTCCGTCTTGACCGTCACGCTGTCCAGATCCGTGATGACCAGTGTTGTGAGCCCA
ACGAAGGCGATCAGCTCCTGGAACCGATGCGCGAACGCACCACCGACTTCAAGGATGGTTAG

>ORF14727c (SEQ ID NO:214)
CAGGAAGTCGGCGAGCTGAAGGATGTCCTCGTGGCCAAGTATGCCCTTGGCGTAGTCACTGCCCACGCCGTAGTTGAACG
TCCTGACGCCGGCCACAGCCTCCAGGCTTCGGACATATCGCTCTTGGTCGGCCTTGTTCCTGTCGCGCGTGGTCTGCCGG
ACACGCGAGCTGTAATTCTCGAACTCTTCTTCAAGTTCGGAGATCCGCCTGCGGATGTCGTTCTGCAGCCAAACCTTGAT
GTCGGCCTGGAACGTCTTTGCAATAGACCAGTAAAAGCTGTGGATGGTCGAGACATGAACCAGCGGGTCATCGTTGACGT
CCGCCAGGATTTCATTGGTGGCAAGGTCGGTATACGTGATGCACGCGACTATCTGCTTCCTCGCCCGCATGCTGGCGCCG
TGCTCCGAGATCACCCAGTCCAGCGCCTTGATGAGGGAGGTGGTCTTGCCGGAACCTGCGCCAGCACGAACCACGAAGGG
CTGCGGAGGCGTCGCTACAATGCATGCGTGGATCTCGCGGTCGGCGTCGGTATCTGGGCTATCAATTCGTCTGCTCATGC
CGTCTGCCCCGGGTCAACAATGATAGCGACAACATCGGCTGTAGTCGGCTCAATAGTCGCGACCTCGGTGGCGATGGCAG
CATCCGCCTCAAGCTCGTGGGCCACTTTGGCTTCGAGCCAGGCCAAGCCCTCGGCGATGTACGCGGGAACCTTCCAGCCA
TTGAGCGGCCCGCTTGCGAGTACCTCCAGCGCAAAGCGGGTCTTGTCGAAGTTCTTGCCGACCACCCTATCGTGTAACTT
CTCAGCCAGCTCTTCAGGGCTGCTCGGTGCGCGCTTGAGCTTGAGGCCGACCGACCGGTTTGCCTCAGCCTGGCACCAGT
CCGCGTTCTCAAGACCAAAGGCCTCCTCAAGTGTGCGGCCGCAGAGCTGTGATGTCGTCGCACCCACCGTCACCGAAACC
TTGGTCTGGTAA

>ORF13779 (SEQ ID NO:216)
CGGTGGGTGCGACGACATCACAGCTCTGCGGCCGCACACTTGAGGAGGCCTTTGGTCTTGAGAACGCGGACTGGTGCCAG
GCTGAGGCAAACCGGTCGGTCGGCCTCAAGCTCAAGCGCGCACCGAGCAGCCCTGAAGAGCTGGCTGAGAAGTTACACGA
TAGGGTGGTCGGCAAGAACTTCGACAAGACCCGCTTTGCGCTGGAGGTACTCGCAAGCGGGCCGCTCAATGGCTGGAAGG
TTCCCGCGTACATCGCCGAGGGCTTGGCCTGGCTCGAAGCCAAAGTGGCCCACGAGCTTGAGGCGGATGCTGCCATCGCC
ACCGAGGTCGCGACTATTGAGCCGACTACAGCCGATGTTGTCGCTATCATTGTTGACCCGGGGCAGACGGCATGAGCAGA
CGAATTGA

Fig. 3-13

>ORF14293c (SEQ ID NO:218)
GGGAGGTGGTCTTGCCGGAACCTGCGCCAGCACGAACCACGAAGGGCTGCGGAGGCGTCGCTACAATGCATGCGTGGATC
TCGCGGTCGGCGTCGGTATCTGGGCTATCAATTCGTCTGCTCATGCCGTCTGCCCCGGGTCAACAATGATAGCGACAACA
TCGGCTGTAGTCGGCTCAATAGTCGCGACCTCGGTGGCGATGGCAGCATCCGCCTCAAGCTCGTGGGCCACTTTGGCTTC
GAGCCAGGCCAAGCCCTCGGCGATGTACGCGGGAACCTTCCAGCCATTGAGCGGCCCGCTTGCGAGTACCTCCAGCGCAA
AGCGGGTCTTGTCGAAGTTCTTGCCGACCACCCTATCGTGTAA

>ORF14155 (SEQ ID NO:220)
CCCGGGGCAGACGGCATGAGCAGACGAATTGATAGCCCAGATACCGACGCCGACCGCGAGATCCACGCATGCATTGTAGC
GACGCCTCCGCAGCCCTTCGTGGTTCGTGCTGGCGCAGGTTCCGGCAAGACCACCTCCCTCATCAAGGCGCTGGACTGGG
TGATCTCGGAGCACGGCGCCAGCATGCGGGCGAGGAAGCAGATAGTCGCGTGCATCACGTATACCGACCTTGCCACCAAT
GAAATCCTGGCGGACGTCAACGATGACCCGCTGGTTCATGTCTCGACCATCCACAGCTTTTACTGGTCTATTGCAAAGAC
GTTCCAGGCCGACATCAAGGTTTGGCTGCAGAACGACATCCGCAGGCGGATCTCCGAACTTGAAGAAGAGTTCGAGAATT
ACAGCTCGCGTGTCCGGCAGACCACGCGCGACAGGAACAAGGCCGACCAAGAGCGATATGTCCGAAGCCTGGAGGCTGTG
GCCGGCGTCAGGACGTTCAACTACGGCGTGGGCAGTGACTACGCCAAGGGCATACTTGGCCACGAGGACATCCTTCAGCT
CGCCGACTTCCTGCTACAAAACCGCCCGCTGTTCCGACGGGTCGTGGCGCTGAGCTACCCGTTCGTGTTTATCGATGAGA
GTCAGGACACGTTCCCGGGTGTAGTGAAGTCTTTCAAGGAAGTGGAAGCCCAGATGCAGGGCAAGTTCTGCCTTGGTTTT
TTCGGCGACCCGATGCAGTCGATCTTCATGAGAGGCGCAGGGGACATCCAGCTTGAGGATCATTGGCGGGCCATCACGAA
GCCGGAGAACTTTCGCTGCGCCAAGCAGATCCTTGACGTCGCCAATGCCGTGCGCGCGCAGGGCGATGGCATGGAGCAAG
TCCGCGGGCTGCACGAGAGGGTCGATGGGAACCTCAAGCTGGTGGAGGGGTCGGCCCGGATGTTCGTCTTGCCGAACACG
CTGAACCGAACCGAGGCTTTGGCAAGAGTCCGAGCGTGGAGCTCGGCGACGAACAACGACGAGGGTTGGACAACCCCAGA
CATCGCAGTCAAGATTCTTGTCATCGTGCACCGCATGGCCGCAAACCGGCTTGGCTTCGGCGGCATCTACTCGGCGCTGA
ACGACAAGACGTCGGATGCCATGAAGCAAGGGATGCAGGACGGCACCGGTTGGCCCGTTCGACCCTTCCTAAGTTTTGCG
CTACCGATCGTTGCAGCTGTGAAGGCCGGCAATGAGTTCGCGGCGATGAGCCTGCTCCGGGAATTCAGCCCGCGCCTGGC
GCCTGCGGCTCTGACCGGCCGACGTGCCGCGGATGTATTGCGAGAGCTGCACGCTGCTGCGTCGAGGCTTGTCGCCATGC
TGGACGAGGCAGGGACCACCATTGGTGACATAGCTCTCCATCTCTGTGACACGGGTCTTTTTGAGTTCGACGAGCGCTAT
GCGCGTGTTCTTGGGTTTGTCAGGGATATTGCTGACACCGCTCAGGAGCCCGAGGCTGCTGATGCAGTTCCGGCCGAAGG
ATTATCCTTGGACGCGACAATGGCCAAGTTCTTCAATTGCTCTGCGCAAGAGCTTTGGCCCTATGAACGCTATGTCTCAG
AAGGCTCCCCCTATGCCACGCAGCACGGCGTGAAGGGAGCGCAGTTCGAACGCGTCATGGTGGTGATGGACGAGGAAGAA
AGCGACTACCGAACGTACAACTACGAGCGTGTCTTCGCGAGTGCTGAGGCCCGCGCTGCAGATCGTGCACGAGCACTAGA
CGGTGATGAAAACACTTGGAGCCGAACGCTGCGACTGCTTTACGTCTGCTGCACTCGTGCCCAGCGGGGCTGGTACTAG
CGTTCTTTGTCGCCGACCCTGCGACCACCCTGGAAAACGTCGTGGCGAGCGGGATCTTGCCGCGAAGCGCAGTCTTTACG
CAGGAAGTGTTAGTTGGATGGCCATAG

>ORF14360 (SEQ ID NO:222)
TCGCGTGCATCACGTATACCGACCTTGCCACCAATGAAATCCTGGCGGACGTCAACGATGACCCGCTGGTTCATGTCTCG
ACCATCCACAGCTTTTACTGGTCTATTGCAAAGACGTTCCAGGCCGACATCAAGGTTTGGCTGCAGAACGACATCCGCAG
GCGGATCTCCGAACTTGAAGAAGAGTTCGAGAATTACAGCTCGCGTGTCCGGCAGACCACGCGCGACAGGAACAAGGCCG
ACCAAGAGCGATATGTCCGAAGCCTGGAGGCTGTGGCCGGCGTCAGGACGTTCAACTACGGCGTGGGCAGTGACTACGCC
AAGGGCATACTTGGCCACGAGGACATCCTTCAGCTCGCCGACTTCCTGCTACAAAACCGCCCGCTGTTCCGACGGGTCGT
GGCGCTGA

>ORF15342c (SEQ ID NO:224)
GAAGGGTCGAACGGGCCAACCGGTGCCGTCCTGCATCCCTTGCTTCATGGCATCCGACGTCTTGTCGTTCAGCGCCGAGT
AGATGCCGCCGAAGCCAAGCCGGTTTGCGGCCATGCGGTGCACGATGACAAGAATCTTGACTGCGATGTCTGGGGTTGTC
CAACCCTCGTCGTTGTTCGTCGCCGAGCTCCACGCTCGGACTCTTGCCAAAGCCTCGGTTCGGTTCAGCGTGTTCGGCAA
GACGAACATCCGGGCCGACCCCTCCACCAGCTTGAGGTTCCCATCGACCCTCTCGTGCAGCCCGCGGACTTGCTCCATGC
CATCGCCCTGCGCGCGCACGGCATTGGCGACGTCAAGGATCTGCTTGGCGCAGCGAAAGTTCTCCGGCTTCGTGATGGCC
CGCCAATGATCCTCAAGCTGGATGTCCCCTGCGCCTCTCATGAAGATCGACTGCATCGGGTCGCCGAAAAACCAAGGCA
GAACTTGCCCTGCATCTGGGCTTCCACTTCCTTGAAAGACTTCACTACACCCGGGAACGTGTCCTGACTCTCATCGATAA
ACACGAACGGGTAGCTCAGCGCCACGACCCGTCGGAACAGCGGGCGGTTTTGTAG

Fig. 3-14

>ORF15260c (SEQ ID NO:226)
ATGCCGCCGAAGCCAAGCCGGTTTGCGGCCATGCGGTGCACGATGACAAGAATCTTGACTGCGATGTCTGGGGTTGTCCA
ACCCTCGTCGTTGTTCGTCGCCGAGCTCCACGCTCGGACTCTTGCCAAAGCCTCGGTTCGGTTCAGCGTGTTCGGCAAGA
CGAACATCCGGGCCGACCCCTCCACCAGCTTGAGGTTCCCATCGACCCTCTCGTGCAGCCCGCGGACTTGCTCCATGCCA
TCGCCCTGCGCGCGCACGGCATTGGCGACGTCAAGGATCTGCTTGGCGCAGCGAAAGTTCTCCGGCTTCGTGATGGCCCG
CCAATGA

>ORF14991 (SEQ ID NO:228)
CGTCGCCAATGCCGTGCGCGCGCAGGGCGATGGCATGGAGCAAGTCCGCGGGCTGCACGAGAGGGTCGATGGGAACCTCA
AGCTGGTGGAGGGGTCGGCCCGGATGTTCGTCTTGCCGAACACGCTGAACCGAACCGAGGCTTTGGCAAGAGTCCGAGCG
TGGAGCTCGGCGACGAACAACGACGAGGGTTGGACAACCCCAGACATCGCAGTCAAGATTCTTGTCATCGTGCACCGCAT
GGCCGCAAACCGGCTTGGCTTCGGCGGCATCTACTCGGCGCTGAACGACAAGACGTCGGATGCCATGAAGCAAGGGATGC
AGGACGGCACCGGTTGGCCCGTTCGACCCTTCCTAAGTTTTGCGCTACCGATCGTTGCAGCTGTGAAGGCCGGCAATGA

>ORF15590c (SEQ ID NO:230)
CGCTCGTCGAACTCAAAAAGACCCGTGTCACAGAGATGGAGAGCTATGTCACCAATGGTGGTCCCTGCCTCGTCCAGCAT
GGCGACAAGCCTCGACGCAGCAGCGTGCAGCTCTCGCAATACATCCGCGGCACGTCGGCCGGTCAGAGCCGCAGGCGCCA
GGCGCGGGCTGAATTCCCGGAGCAGGCTCATCGCCGCGAACTCATTGCCGGCCTTCACAGCTGCAACGATCGGTAGCGCA
AAACTTAGGAAGGGTCGAACGGGCCAACCGGTGCCGTCCTGCATCCCTTGCTTCATGGCATCCGACGTCTTGTCGTTCAG
CGCCGAGTAG

>ORF15675c (SEQ ID NO:232)
TCCTTCGGCCGGAACTGCATCAGCAGCCTCGGGCTCCTGAGCGGTGTCAGCAATATCCCTGACAAACCCAAGAACACGCG
CATAGCGCTCGTCGAACTCAAAAAGACCCGTGTCACAGAGATGGAGAGCTATGTCACCAATGGTGGTCCCTGCCTCGTCC
AGCATGGCGACAAGCCTCGACGCAGCAGCGTGCAGCTCTCGCAATACATCCGCGGCACGTCGGCCGGTCAGAGCCGCAGG
CGCCAGGCGCGGGCTGAATTCCCGGAGCAGGCTCATCGCCGCGAACTCATTGCCGGCCTTCACAGCTGCAACGATCGGTA
G

>ORF16405 (SEQ ID NO:234)
ATCGACTCTTTGAGGAAATGCGTGGGAAGCCTGGAAAAGTGCTGTTTCGCCTGCAAAGAAATAATTCATGTTCATGCGAT
TCGTTGTCGGCAGTGCGGCGAGTCCCAAGGCTGGCGAAGGTTCATGAGCTCTCCAACCTCAGTAGTTGCGTTGGTCCTTA
GCCTTTTATCAATCGCTGCCACAAAACCTGTGGAGCGATTGTTCGATGCCCAGCGAGCAGAGCTACAAATCTCCATCACG
GGTGGTGATTACAAAGCTGCCCAGCTTATGTTGACCAATAACGGGTCAAAGCCTGCAACTTTAGTTTCCTTCGAAATCAC
ATCGAAAGCCACGACCAATACGAAAACATGGTTTTTGGTAAGCAATACGGATGGCGAAATTCTGGAGCCAGGCAAAACTT
ACAAAATCAGGGCCTCAACCGATGAGTCTATCCCAAAAATTGTCGAAGCTGAGCGTCGGACGATTTTGAAGTCTCAGTAC
GCACTTGCAGATAATTGCGAATTAACCGCTAAATACATAGAGGCCACGGGGCAGAAGGTTGTGCGTGTGCAACCGTTCAT
GTGCGACACACCTCCTGAAAAGGGTGGCCTGCCCCCTGGTAAACCTGGCATACCCATTTGGTACCTTGGTCAAGAATGA

>ORF16925 (SEQ ID NO:236)
AGGCCACGGGGCAGAAGGTTGTGCGTGTGCAACCGTTCATGTGCGACACACCTCCTGAAAAGGGTGGCCTGCCCCCTGGT
AAACCTGGCATACCCATTTGGTACCTTGGTCAAGAATGATGTTTTTATGCCGCCCTGGGCTTTGACGCCGATTAAGCAAA
GCTGTGTTCGCTCATCCAATACGTCCCTCGCCCAGTTAAACGACTGTTATGTATATGGGTGCTGCCGCTACGTAATACCT
TGGCCCTACGCATACGAAGTTAATTCTGAAAGCGTTCAATGGACAATCTTCCTCCTCGGCGTCGACTGCAGCGGTAAGGT
GATCTACTTTCGAAACACTGCAAGGGTAGGTCCTTTTTTGGCAGCGTCCATATACCGACCGTGGTATGGCTCAGATGCGC
TGGTACTGCATTTCACCAAATAA

Fig. 3-15

>ORF17793c (SEQ ID NO:238)
GCCAAAATGATTGTCATTGACAAAAATCTAGAACATCTTGTTGCGCAATGCGCTATATGTGAAAAAACTTTATTTGACGA
GTTTTCTCTCAAGATTCAATTGGGGCATACATATTACGAGCCAAAATCTTTGCCCGCCTCTGCAAGCATTGTATATGGGT
CGCATCCAGCCCCGTCGACGTTTTTTTTGGAACCAAAAGAAATTCAGCAAAATTTGGTGCTGAAATCCGGTGAGCAAGTC
ATCACCTGCAGTAAACATCGATACAAAATACCGTTAGATTATTTTGGTCTGGTGCAAACCAAAGGAACCCTTGCGCGATT
GTTCGTGCAGGTAACCTGTAATGACGGTCAGGTAGAGCCGGGGTTCGACGGGTACGTAACCCTTGAAATCGTCAATATGT
CGCCTTGGACGATAGAAATACCGGCCGTGAGCGATATAGCACAACTTTATTTGGTGAAATGCAGTACCAGCGCATCTGAG
CCATACCACGGTCGGTATATGGACGCTGCCAAAAAAGGACCTACCCTTGCAGTGTTTCGAAAGTAG

>ORF18548c (SEQ ID NO:240)
AGGACAATGGCAGGGTGGCCGCGTCTCGCAGCCCAAGGACGAAGGACAAATCTGATGAGTGTGTTACAGATCAAAGGGCG
TACAACGAAATCCCACACGGATTTTGACGCGGCATCGTACTCCAGCAACAGCCTTATACTCACTGATGCAGGGGACGAGA
GAATTGAAGAGTTTTCCCTCGAATTGTCCGTGGGTGAAGGGTGGAGTGATAACTATTCTGGCAACGACAAAAACCTGTGG
CGCATTGTCGATGGTATGACGATCAGGGGTCACGATTCTGTTGTGGTGGAGGCCGCTGAAGAAATCAAGGTGCCGCACAA
TCGGTACGGCATAGTCCTACCTACGGGAAGTCTTTTTCTCTCACGCGGCGTGCTGGTTGCTTCGGCGAAGGTCGAACCTG
CATTTGATGGCAAGCTCAAGCTCAGGATATTCAACACCACCAACAAAAATGTCTGCCTTACCAAAGGCGAGAAGCTTGGC
TCTGTGATTTTTTTCTCCACAGAATCGACGCACACCCAAAGCCCCATCAAGCGTGGCAGTGAAATATCGACGCTTCCCAT
CACGCGGCGCGCGATTGAAGAAGTGGTTTTCGCTCAATCCCACCATATGGGTCGGGTGGACGCTGAATTTAATCGGAA
GTTCCCTGGTGTCTTCTCTTATAATGTACGCCGTCTATTACAAGGTTGTGCTGGAACACCAGTCGCAGCCTCCTCAGTCA
CAACAAAACGCTCAGCCATCGCCGAACGAAGTTAAGCCAAAATGA

>ORF17875 (SEQ ID NO:242)
ACGGCGTACATTATAAGAGAAGACACCAGGGAACTTCCGATTAAATTCAGCGTCCACCCGACCCATATGGTGGGATTGAG
CGAAAACCACTTCTTCAATCGCGCGCGCCGCGTGATGGGAAGCGTCGATATTTCACTGCCACGCTTGATGGGGCTTTGGG
TGTGCGTCGATTCTGTGGAGAAAAAAATCACAGAGCCAAGCTTCTCGCCTTTGGTAAGGCAGACATTTTTGTTGGTGGTG
TTGAATATCCTGAGCTTGAGCTTGCCATCAAATGCAGGTTCGACCTTCGCCGAAGCAACCAGCACGCCGCGTGAGAGAAA
AAGACTTCCCGTAGGTAGGACTATGCCGTACCGATTGTGCGGCACCTTGATTTCTTCAGCGGCCTCCACCACAACAGAAT
CGTGA

>ORF18479 (SEQ ID NO:244)
TCTGTAACACACTCATCAGATTTGTCCTTCGTCCTTGGGCTGCGAGACGCGGCCACCCTGCCATTGTCCTTTATACCGGC
CGATATCCCCGGATACCGCCTGAAAGATGACGTGCGCAAAGCGTGCACCAATCTGAATTTCAAACGCCTCGCTGTGATTG
TTGGTGAGCGCGAACGTCATCGGCCCTACATAACCTGGAGGCAGCACACTGGAACTGAACGTTATCCCGCTTCTGAACAG
CGTGCTTCTCGGAAAAAAAAGCGCCGCCAGATCTTCCGGCAGATCGAATTCTTCCATGGTGCTCGCCAGATAAGTCTTGC
CCGGTTCCATGACGAAGCAGTCATCCGGGTCTGCGAGCACGACCTCGCTGGCAGGGGTGCGTCGCGTAGATTCTCGCAAG
CTTCCACCCCCTACTGTCAGGCGAGAGAGGCCTGCGAGTCTGAGGTCAAATCCAACGCCTTCCGGGGTGGTCAACTCACG
GTGGGCAAGGTGCTTGATTAG

>ORF19027c (SEQ ID NO:246)
ATGATTTACTCACCGCACTCGCTCCTGAAACTGGTCCGGGATGGAAAACTAATCAAGCACCTTGCCCACCGTGAGTTGAC
CACCCCGGAAGGCGTTGGATTTGACCTCAGACTCGCAGGCCTCTCTCGCCTGACAGTAGGGGGTGGAAGCTTGCGAGAAT
CTACGCGACGCACCCCTGCCAGCGAGGTCGTGCTCGCAGACCCGGATGACTGCTTCGTCATGGAACCGGGCAAGACTTAT
CTGGCGAGCACCATGGAAGAATTCGATCTGCCGGAAGATCTGGCGGCGCTTTTTTTTCCGAGAAGCACGCTGTTCAGAAG
CGGGATAACGTTCAGTTCCAGTGTGCTGCCTCCAGGTTATGTAGGGCCGATGACGTTCGCGCTCACCAACAATCACAGCG
AGGCGTTTGAAATTCAGATTGGTGCACGCTTTGCGCACGTCATCTTTCAGGCGGTATCCGGGGATATCGGCCGGTATAAA
GGACAATGGCAGGGTGGCCGCGTCTCGCAGCCCAAGGACGAAGGACAAATCTGA

>ORF19305 (SEQ ID NO:248)
TGGCCGTTCTCTGCCTGTCGCCTCTTTGGCATGACTGGTCAAGTCGGATGCAAACGGTGGTCAGCACCAATGCAATTGGG
TGGTCATGTGCGATGCAATTACGCAGTTGAGCCTGGCCCAGTTCCTCCCAAGCAAAGCATAAGACCAAGATGGCACATTG
CCAACAAATACCCTTCCCCGCTACCGTTGTTTTATCGTTGTTGCCAGCCCTGATCTGGCGGAAAAGCCCGCTCCATGAA
TCGTCATGGAGCCTCCCATGTTTCAACTCCTTTCCTGGATATCCAGGAAGCCGTCCCCCACCCCAACAACCAAAGCTGCC
CCAGGGGGATTCATCCTTCCTCTGA

Fig. 3-16

>ORF19519 (SEQ ID NO:250)
TCTGGCGGAAAAGCCCGCTCCATGAATCGTCATGGAGCCTCCCATGTTTCAACTCCTTTCCTGGATATCCAGGAAGCCGT
CCCCCACCCCAACAACCAAAGCTGCCCCAGGGGGATTCATCCTTCCTCTGAGCAGCATGGAACTGCTCGGCACGCCTCGC
CGCCGGCAGCTACTGGAGAACATCTGGCAGCGCGCCTCGCTATCCAAGCAGCAATTCGAGGAGATCTACCGGCGGCCACT
GGCCAACTATGCCGAGCTGGTCCAGCAGCTCCCTGCTTCGGAAAATCATCACCATGCCCATCCAGGCGGGATGATCGATC
ACGGCCTGGAGATCGTGGCCTACGCACTCAAGGTACGGCAGACCTACCTGCTCCCGATCGGCGCAGCGCCGGAGTCACAG
TCAGCCCAGGCTGA

>ORF19544 (SEQ ID NO:252)
ATCGTCATGGAGCCTCCCATGTTTCAACTCCTTTCCTGGATATCCAGGAAGCCGTCCCCCACCCCAACAACCAAAGCTGC
CCCAGGGGGATTCATCCTTCCTCTGAGCAGCATGGAACTGCTCGGCACGCCTCGCCGCCGGCAGCTACTGGAGAACATCT
GGCAGCGCGCCTCGCTATCCAAGCAGCAATTCGAGGAGATCTACCGGCGGCCACTGGCCAACTATGCCGAGCTGGTCCAG
CAGCTCCCTGCTTCGGAAAATCATCACCATGCCCATCCAGGCGGGATGATCGATCACGGCCTGGAGATCGTGGCCTACGC
ACTCAAGGTACGGCAGACCTACCTGCTCCCGATCGGCGCAGCGCCGGAGTCACAGTCAGCCCAGGCTGAAGCCTGGTCGG
CCGCCGCGGCGTATGGCGCCCTGGCTCATGACATAGGCAAGATCGTCGTCGACCTGCAGGTTGAGCTACAGGACGGCAGC
ACCTGGCACCCTTGGAACGGACCGATCAACCAGCCATACCGCTTCAAGTACGTGAAGTCCCGCGAATACCAGCTCCACGG
CGCTGCCTCAGCACTTCTCATCCACCAACTGCTACCGCGCACTGCACTCGATTGGCTCAGTCGCTTTCCAGAGCTGTGGG
CTCAATTGATCTACCTGTTCGCTGGGCAGTACGAGCACGCCGGGATCCTCGGCGAGATCATCGTGAAGGCAGACCAGGCC
TCAGTTGCACAGGAGCTAGGAGGCAATCCGGATCGAGCTCTGGCTGCACCGAAGCAGTCGCTGCAGCGGCAGTTGGCAGA
CGGCCTTCGCTTCTTGGTGAAGGACAAGTTCAAGTTGAATCAACCTAGCGGCCCGTCTGATGGATGGCTGACCCAGGACG
CACTCTGGCTGGTGAGCAAGCCTGCTGCCGATCAACTGAGAGCCTACCTGCTGGCCCAGGGTATCGATGGGGTGCCCTCC
TCTAACGCGCCGTTCTTCAGCATGCTCCAGGACCAAGCCGTCATCCAGACAAATGCCGAGGACAAGGCCATTTGGACGGC
CACGGTAGACAACGGTGCTGGATGGAGAAACAAGTTCACGCTACTCAAGATTGCTCCAGCCTTGATCTGGACAGATGCTG
CCGAGCGCCCCTCACCCTACAGCGGATCACTGGTCGTTGAAGATGGAACCGCCTCAACGGAAAAGCCGGAAACGACCTGT
GAAATTCCCAACGGGCCGGCTGAACAGCAGCAAGCACCAGAAACGAAGATGATGCTCCATCAACCTGCGCCGAGCGTTGC
GAAACCGGCAAACGAGACGCAGGCGATTGCGAAACCCTCAACTGATGATCAAGAAGAAACAGACGATTTGTATGCACTTC
TTGGTAATATCAATTCGCCACTAGAAGAGCTAGACACTAGCCACGACTCGCCGGCTGCCTCTCCTACGAACACACGCGGG
GAGGAGAACCTACAGCAGCCACTAGGGACCAAGGAGCCAACAGATTGCGCTCCTGAAGCAATTGAAGATGTATTTATGCC
TAGCAGAAGTACTGATCTGGGACAGGGATTCGTTGGTTGGATGAAATCTGGCATCGCGGCCCGTCGCCTGTTCATCAACG
ACACCAAGGCTTTGGTGCATACCGTAGACGGGACCGCCATGCTGGTCACGCCAGGAATTTTCAAGCGCTATGTCCAAGAG
CATCCGGTGCTTGAAAAACTGGCCCAAGCCAAGGAGACGACCGGCTGGAAGCTGGTGCAGCGCGCGTTCGAAAAACAGGG
GCTTCATCGGAAGACCAGTAAAAACCTGAACATCTGGACCATCAAGGTTTCTGGTCCTCGCAAGACGAAAGAGCTCAAGG
CCTACCTGCTCCAGGATCCCAAATTGCTGTTCCCTGAGCAGCCTCTGGACAACCCAAGCCTCACGGTCATCACCGATGCC
GAAGGAGGTGTGGAATGA

>ORF20008 (SEQ ID NO:254)
GCTACAGGACGGCAGCACCTGGCACCCTTGGAACGGACCGATCAACCAGCCATACCGCTTCAAGTACGTGAAGTCCCGCG
AATACCAGCTCCACGGCGCTGCCTCAGCACTTCTCATCCACCAACTGCTACCGCGCACTGCACTCGATTGGCTCAGTCGC
TTTCCAGAGCTGTGGGCTCAATTGATCTACCTGTTCGCTGGGCAGTACGAGCACGCCGGGATCCTCGGCGAGATCATCGT
GAAGGCAGACCAGGCCTCAGTTGCACAGGAGCTAGGAGGCAATCCGGATCGAGCTCTGGCTGCACCGAAGCAGTCGCTGC
AGCGGCAGTTGGCAGACGGCCTTCGCTTCTTGGTGAAGGACAAGTTCAAGTTGAATCAACCTAG

>ORF20623c (SEQ ID NO:256)
CGTGAACTTGTTTCTCCATCCAGCACCGTTGTCTACCGTGGCCGTCCAAATGGCCTTGTCCTCGGCATTTGTCTGGATGA
CGGCTTGGTCCTGGAGCATGCTGAAGAACGGCGCGTTAGAGGAGGGCACCCCATCGATACCCTGGGCCAGCAGGTAGGCT
CTCAGTTGATCGGCAGCAGGCTTGCTCACCAGCCAGAGTGCGTCCTGGGTCAGCCATCCATCAGACGGGCCGCTAGGTTG
ATTCAACTTGAACTTGTCCTTCACCAAGAAGCGAAGGCCGTCTGCCAACTGCCGCTGCAGCGACTGCTTCGGTGCAGCCA
GAGCTCGATCCGGATTGCCTCCTAG

Fig. 3-17

\>ORF21210c (SEQ ID NO:258)
CGCTTGAAAATTCCTGGCGTGACCAGCATGGCGGTCCCGTCTACGGTATGCACCAAAGCCTTGGTGTCGTTGATGAACAG
GCGACGGGCCGCGATGCCAGATTTCATCCAACCAACGAATCCCTGTCCCAGATCAGTACTTCTGCTAGGCATAAATACAT
CTTCAATTGCTTCAGGAGCGCAATCTGTTGGCTCCTTGGTCCCTAGTGGCTGCTGTAGGTTCTCCTCCCCGCGTGTGTTC
GTAGGAGAGGCAGCCGGCGAGTCGTGGCTAGTGTCTAGCTCTTCTAGTGGCGAATTGATATTACCAAGAAGTGCATACAA
ATCGTCTGTTTCTTCTTGA

\>ORF21493c (SEQ ID NO:260)
GCTGCTGCGGCGTCATTCCACACCTCCTTCGGCATCGGTGATGACCGTGAGGCTTGGGTTGTCCAGAGGCTGCTCAGGGA
ACAGCAATTTGGGATCCTGGAGCAGGTAGGCCTTGAGCTCTTTCGTCTTGCGAGGACCAGAAACCTTGATGGTCCAGATG
TTCAGGTTTTTACTGGTCTTCCGATGAAGCCCCTGTTTTTCGAACGCGCGCTGCACCAGCTTCCAGCCGGTCGTCTCCTT
GGCTTGGGCCAGTTTTTCAAGCACCGGATGCTCTTGGACATAGCGCTTGAAAATTCCTGGCGTGACCAGCATGGCGGTCC
CGTCTACGGTATGCACCAAAGCCTTGGTGTCGTTGATGAACAGGCGACGGGCCGCGATGCCAGATTTCATCCAACCAACG
AATCCCTGTCCCAGATCAGTACTTCTGCTAGGCATAAATACATCTTCAATTGCTTCAGGAGCGCAATCTGTTGGCTCCTT
GGTCCCTAG

\>ORF21333 (SEQ ID NO:262)
ACATCTGGACCATCAAGGTTTCTGGTCCTCGCAAGACGAAAGAGCTCAAGGCCTACCTGCTCCAGGATCCCAAATTGCTG
TTCCCTGAGCAGCCTCTGGACAACCCAAGCCTCACGGTCATCACCGATGCCGAAGGAGGTGTGGAATGACGCCGCAGCAG
CTCACCGAGGAGTACATCTTCGCGCACGATCTCCGGGAAGCCAGCGCGAAGATCTACCGCGCCGCGACCAAGGCGCTGCT
CAAGCACTTCGGTCCTACGGCAACCGTACAGGACGTGGACCACCGGGCTGTCCTGGGATGGCGACGCAAGGTACTGGAAC
AAGGCCTGTCCAAGCGGAGCTGGAACACGTACTCGAATCATCTGCGGACGATCTGGGGCTATGCCATCGAGCATGA

\>ORF22074c (SEQ ID NO:264)
GTGAGGCACAAGCCCCTCCGTTATTGGCACTACGAACTCTTTGTGAGTCTTCTCTGTCTCGCCGCGGATGAGGATCAGTT
GATTTTCCCAGTCGATGTCGCGCTTGCGGATGCACAACAGCGCATTCAACCGGATGCCGGTGAAGTAGAAGACCTCAAAC
GTGCAAAGCCAGAACCAGGCGGGCGTGATCCGTGCGCGTTCGCCGGTGCAGCGCTCTGCGCCGTCCTGCATGTTGAGCCA
ATTGCGGGCGAGCAGGATGGCTTCGGCGGCGACGGTTTTGCTTGCTCGCCTGGGGGGAATGACGGTGGTCTTTCTGAACG
GGTTGACTTGGGAGTGCGTCACCAACTCATGCTCGATGGCATAGCCCCAGATCGTCCGCAGATGATTCGAGTACGTGTTC
CAGCTCCGCTTGGACAGGCCTTGTTCCAGTACCTTGCGTCGCCATCCCAGGACAGCCCGGTGGTCCACGTCCTGTACGGT
TGCCGTAGGACCGAAGTGCTTGAGCAGCGCCTTGGTCGCGGCGCGGTAGATCTTCGCGCTGGCTTCCCGGAGATCGTGCG
CGAAGATGTACTCCTCGGTGAGCTGCTGCGGCGTCATTCCACACCTCCTTCGGCATCGGTGATGACCGTGAGGCTTGGGT
TGTCCAGAGGCTGCTCAGGGAACAGCAATTTGGGATCCTGGAGCAGGTAG

\>ORF21421 (SEQ ID NO:266)
GCAGCCTCTGGACAACCCAAGCCTCACGGTCATCACCGATGCCGAAGGAGGTGTGGAATGACGCCGCAGCAGCTCACCGA
GGAGTACATCTTCGCGCACGATCTCCGGGAAGCCAGCGCGAAGATCTACCGCGCCGCGACCAAGGCGCTGCTCAAGCACT
TCGGTCCTACGGCAACCGTACAGGACGTGGACCACCGGGCTGTCCTGGGATGGCGACGCAAGGTACTGGAACAAGGCCTG
TCCAAGCGGAGCTGGAACACGTACTCGAATCATCTGCGGACGATCTGGGGCTATGCCATCGAGCATGAGTTGGTGACGCA
CTCCCAAGTCAACCCGTTCAGAAAGACCACCGTCATTCCCCCAGGCGAGCAAGCAAAACCGTCGCCGCCGAAGCCATCC
TGCTCGCCCGCAATTGGCTCAACATGCAGGACGGCGCAGAGCGCTGCACCGGCGAACGCGCACGGATCACGCCCGCCTGG
TTCTGGCTTTGCACGTTTGAGGTCTTCTACTTCACCGGCATCCGGTTGAATGCGCTGTTGTGCATCCGCAAGCGCGACAT
CGACTGGGAAAATCAACTGATCCTCATCCGCGGCGAGACAGAGAAGACTCACAAAGAGTTCGTAGTGCCAATAACGGAGG
GGCTTGTGCCTCACCTATCGAGGCTCCTGCAAGAGGCCGATAGAGCCGGATTCGCCGATGACGACCAGTTGTTCAACGTC
AACCGGTTCTCACCGCACTACAAGAGCAAGGTGATGAACTCCGACCAGGTCGAAGCCATGTACCGGAAGTTGACCGAGAA
GGTTGGGGTGCGGATGACCCCGCACCGTTTCCGGCACACCCTGGCCACCGACTTGATGAAGGCACCCGAGCGGAACATTC
ACCTCACGAAGTGCCTGCTCAACCACTCGAATATCCAGACCACGATGAGCTACATCGAGGCCGACTACGATCACATGCGT
GCCGTGCTGCATGCTAGAAGCCTGGCCCAAGGCGCGCTGGAGAATGTCAGGAAGGTGGATTACAGCGGCTCCCCGCAAGC
CTCTGCCAAACCGAAGCCATGCGGGCAACCTCTCGCTCGAGTGAGTGAAGCGCCGCCACCGGAGGCCAGGACAGAGCCTG
CAGAACCAAGGGAGCACACGCCAGGACAGGCATTCAGGGAGGTCCAACCGCGTGGGAAGCAGATGCGCTACCACAGCCA
CCTGACACCTTCGAACCAAGCGTGCTGTTCACTCTGATGGCTCAAAACTTATCGAACCGTGCCGCCTCGGCATCCGCGGC
TCCCGCTGCAACAAGCGGATCAGGCGGATGGGGATCTGCCGCCCGAAGCAATCTCGCCTAG

Fig. 3-18

>ORF22074c (SEQ ID NO:264)
GTGAGGCACAAGCCCCTCCGTTATTGGCACTACGAACTCTTTGTGAGTCTTCTCTGTCTCGCCGCGGATGAGGATCAGTT
GATTTTCCCAGTCGATGTCGCGCTTGCGGATGCACAACAGCGCATTCAACCGGATGCCGGTGAAGTAGAAGACCTCAAAC
GTGCAAAGCCAGAACCAGGCGGGCGTGATCCGTGCGCGTTCGCCGGTGCAGCGCTCTGCGCCGTCCTGCATGTTGAGCCA
ATTGCGGGCGAGCAGGATGGCTTCGGCGGCGACGGTTTTGCTTGCTCGCCTGGGGGAATGACGGTGGTCTTTCTGAACG
GGTTGACTTGGGAGTGCGTCACCAACTCATGCTCGATGGCATAGCCCCAGATCGTCCGCAGATGATTCGAGTACGTGTTC
CAGCTCCGCTTGGACAGGCCTTGTTCCAGTACCTTGCGTCGCCATCCCAGGACAGCCCGGTGGTCCACGTCCTGTACGGT
TGCCGTAGGACCGAAGTGCTTGAGCAGCGCCTTGGTCGCGGCGCGGTAGATCTTCGCGCTGGCTTCCCGGAGATCGTGCG
CGAAGATGTACTCCTCGGTGAGCTGCTGCGGCGTCATTCCACACCTCCTTCGGCATCGGTGATGACCGTGAGGCTTGGGT
TGTCCAGAGGCTGCTCAGGGAACAGCAATTTGGGATCCTGGAGCAGGTAG

>ORF21421 (SEQ ID NO:266)
GCAGCCTCTGGACAACCCAAGCCTCACGGTCATCACCGATGCCGAAGGAGGTGTGGAATGACGCCGCAGCAGCTCACCGA
GGAGTACATCTTCGCGCACGATCTCCGGGAAGCCAGCGCGAAGATCTACCGCCGCGACCAAGGCGCTGCTCAAGCACT
TCGGTCCTACGGCAACCGTACAGGACGTGGACCACCGGGCTGTCCTGGGATGGCGACGCAAGGTACTGGAACAAGGCCTG
TCCAAGCGGAGCTGGAACACGTACTCGAATCATCTGCGGACGATCTGGGGCTATGCCATCGAGCATGAGTTGGTGACGCA
CTCCCAAGTCAACCCGTTCAGAAAGACCACCGTCATTCCCCCAGGCGAGCAAGCAAAACCGTCGCCGCCGAAGCCATCC
TGCTCGCCCGCAATTGGCTCAACATGCAGGACGGCGCAGAGCGCTGCACCGGCGAACGCGCACGGATCACGCCCGCCTGG
TTCTGGCTTTGCACGTTTGAGGTCTTCTACTTCACCGGCATCCGGTTGAATGCGCTGTTGTGCATCCGCAAGCGCGACAT
CGACTGGGAAAATCAACTGATCCTCATCCGCGGCGAGACAGAGAAGACTCACAAAGAGTTCGTAGTGCCAATAACGGAGG
GGCTTGTGCCTCACCTATCGAGGCTCCTGCAAGAGGCCGATAGAGCCGGATTCGCCGATGACGACCAGTTGTTCAACGTC
AACCGGTTCTCACCGCACTACAAGAGCAAGGTGATGAACTCCGACCAGGTCGAAGCCATGTACCGGAAGTTGACCGAGAA
GGTTGGGGTGCGGATGACCCCGCACCGTTTCCGGCACACCCTGGCCACCGACTTGATGAAGGCACCCGAGCGGAACATTC
ACCTCACGAAGTGCCTGCTCAACCACTCGAATATCCAGACCACGATGAGCTACATCGAGGCCGACTACGATCACATGCGT
GCCGTGCTGCATGCTAGAAGCCTGGCCCAAGGCGCGCTGGAGAATGTCAGGAAGGTGGATTACAGCGGCTCCCCGCAAGC
CTCTGCCAAACCGAAGCCATGCGGGCAACCTCTCGCTCGAGTGAGTGAAGCGCCGCCACCGGAGGCCAGGACAGAGCCTG
CAGAACCAAGGGAGCACACGCCAGGACAGGCATTCAGGGAGGTCCAACCGCGTGGGAAGCAGATGCGCTACCACAGCCA
CCTGACACCTTCGAACCAAGCGTGCTGTTCACTCTGATGGCTCAAAACTTATCGAACCGTGCCGCCTCGGCATCCGCGGC
TCCCGCTGCAACAAGCGGATCAGGCGGATGGGGATCTGCCGCCCGAAGCAATCTCGCCTAG

>ORF22608c (SEQ ID NO:268)
CGCATCTGCTTCCCACGCGGTTGGACCTCCCTGAATGCCTGTCCCTGGCGTGTGCTCCCTTGGTTCTGCAGGCTCTGTCC
TGGCCTCCGGTGGCGGCGCTTCACTCACTCGAGCGAGAGGTTGCCCGCATGGCTTCGGTTTGGCAGAGGCTTGCGGGGAG
CCGCTGTAATCCACCTTCCTGACATTCTCCAGCGCGCCTTGGGCCAGGCTTCTAGCATGCAGCACGGCACGCATGTGATC
GTAGTCGGCCTCGATGTAGCTCATCGTGGTCTGGATATTCGAGTGGTTGAGCAGGCACTTCGTGAGGTGAATGTTCCGCT
CGGGTGCCTTCATCAAGTCGGTGGCCAGGGTGTGCCGGAAACGGTGCGGGGTCATCCGCACCCCAACCTTCTCGGTCAAC
TTCCGGTACATGGCTTCGACCTGGTCGGAGTTCATCACCTTGCTCTTGTAGTGCGGTGA

>ORF22626 (SEQ ID NO:270)
CACCTTCGAACCAAGCGTGCTGTTCACTCTGATGGCTCAAAACTTATCGAACCGTGCCGCCTCGGCATCCGCGGCTCCCG
CTGCAACAAGCGGATCAGGCGGATGGGGATCTGCCGCCCGAAGCAATCTCGCCTAGCGATACCGGTACTGAGGGCCGGCT
ACCGGACGAAAGGTAGCCGTGCCTTCCAGCAGATCGTTAGGCCTGTAGGAAAAATCTGGAATTACCGAGAGCGCCTGGAT
TCCAGCGCCGGCATGCTGGCAGAGCCAGCGCAATTTCAAGGCCAATACCACAGTACCCTCTGTAATCGCTGA

Fig. 3-19

>ORF23228 (SEQ ID NO:272)
AGAGATTCGAACTCCCGACATCCTGCTCCCAAAGCAGGCGCGCTACCGGACTGCGCTATACCCCGATTGGAATTTGGCTC
CGCGACCTGGACTCGAACCAGGGACCCAATGATTAACAGTCATTTGCTCTACCGACTGAGCTATCGCGGAACGTCTTTCT
TCCAACCCTGGACGCTTCCGGTGTTGCTGGATTCGCGTCTCAGAGGCGCGCCATTTTACGGATGCGCGCGGGCATGTCAA
CCCTCTGATCCAAAAAGTTTTTCTTCTTTTTCCACGAGCGACAAAACGGCCCTTCCACTGCATGCGGCAGCGCTCTCGCG
CCTACCGGACGCCCATGAAAAAGCCCCGCCGAAGCGGGGCTTTCCCTGTCCGCCCCCGAAGAGGTCAGGCGAAGACGATC
TCGTCGCCTTCCACCTTCGCCGAGATACTGGCACCCGGCGCGAATTTGCCGGCCAGGATCAGTTGCGCCAGCGGGTTCTC
GATCCAGCGCTGGATGGCCCGCTTCAGCGGGCGTGCGCCATAGACCGGGTCGAAGCCGACGGCAATCAGCTTGTCCAGCG
CCTCCTGGCTCAGTTCCAGGCTCAGCTCGCGCTCGGCCAGGCGCTTGCGCAGGCGACCGAGCTGGATCTCGGCGATGCCG
GCGATCTGCTCGCGAGCCAGCGGCTCGAACACCACCACTTCGTCGATCCGGTTGATGAATTCCGGACGGAAGTGCGCATT
GACCGCGTCCATCACTGCGGCACGTTGCGCCTCGCGGTCGCCGGCCAGCTCCTGGATCTGCGCCGAACCGAGGTTGGAGG
TCATCACCACCACGGTGTTGCGGAAGTCCACCGTACGCCCGTGACTGTCGGTCAGGCGTCCGTCCTCGAGCACCTGGAGG
AGAATGTTGAATACATCCGGATGGGCCTTCTCCACCTCGTCCAGCAGCACCACCGAGTAGGGCTTGCGGCGGATCGCCTC
GGTCAGGTAGCCGCCTTCCTCGAAGCCGACGTAGCCCGGAGGCGCGCCGATCAGGCGGGCCACCGAGTGTTTCTCCATGA
ACTCGGACATATCTATCCGCACCAGCGCCTCCTCGGTATCGAAGAGGAACTCGGCCAGCGCCTTGCACAACTCGGTCTTG
CCCACCCCGGTCGGGCCGAGGAAGAGGAACGAGCCGCTCGGCCGGTTCGGATCGGCGAGGCCGGCGCGCGAACGGCGCAC
GGCGTTGGACACGGCGACTACCGCCTCGTCCTGGCCGATCACTCGCCGATGCAGCTCCTGCTCCATGCGCAGCAGCTTCT
CGCGCTCGCCCTCGAGCATCTTCGACACCGGGATACCGGTCCACTTGGAAACCACTTCGGCGATTTCCTCGTCGGTCACC
TTGTTGCGCAGCAACTGGTTCTCGGTCTTGCCGTGCTGGTCGACCATCTGCAGGCTGCGTTCCAGGTCCGGGATGGTCTG
GTACTGGATGCGCGCCATGCTCTCGAGGTCGCCCTTGCGCCGCGCCGCCTCCATCTCCTGCTTGGCCTGCTCGATCTTCT
GCTGGATCTGCGCCGAGCCCTGCACCTCGGCCTTCTCGGACTTCCAGATCTCCTCGAGGTCGGCGTATTCGCGCTCGAGC
TTGACGATATCCTCCTCCAGCTTGGCCAGGCGCTTCCTGGTGGCTTCGTCGTCTTCCTTCTTCAGCGCCTCGCGCTCGAT
CTTCAGCTGGATCAGGCGACGGTCGAGACGATCCAGTTCCTCCGGCTTGGAGTCGATCTCCATGCGGATGCGGCTGGCGG
CCTCGTCGATCAGGTCGATGGCCTTGTCCGGCAGTTGCCGATCGGTGATGTAGCGGTGCGACAGCTTGGCCGCGGCGATG
ATCGCGCCGTCGGTGATGCTCACCCCGTGGTGCACTTCATAGCGTTCCTTGAGGCCACGGAGGATGGCGATGGTGTCTTC
CTCGCTCGGTTCGTCCACCAGCACCTTCTGGAAGCGGCGCTCCAGCGCGGCATCCTTCTCGATGTACTGGCGATACTCGT
CGAGGGTAGTAGCACCGACGCAGTGCAGCTCGCCGCGCGCCAGAGCCGGCTTGAGCATGTTGCCGGCGTCCATGGCACCT
TCCGCCTTGCCGGCGCCGACCATGGTGTGCAGTTCGTCGATGAACAGGATGACCCGGCCTTCCTGCTTGCCCAGTTCGTT
GAGGACCGCCTTCAGGCGTTCCTCGAACTCGCCGCGGAACTTGGCACCGGCGATCAGCGCCCCATGTCCAGGGCCAGCA
GGCGCTTGTCCTTGAGGCCGTCCGGCACTTCGCCGTTGATGATGCGCTGGGCCAGGCCCTCGACGATGGCGGTCTTGCCG
ACGCCGGGTTCGCCGATCAGCACCGGGTTGTTCTTGGTCCGCCGCTGCAGGACCTGGATGGTCCGGCGGATCTCGTCGTC
GCGACCGATCACCGGGTCGAGCTTGCCTTCCTCGGCGCGCTTGGTCATGTCGACGGTGTACTTGTCCAGCGCCTGGCGCG
ACTCCTCGACGTTCGGGTCGTTCACCGCTTCGCCGCCACGCAGGTTGGCCACGGCATTCTCCAGCGCCTTGCGCGACACG
CCCTGGCCGAGCAGCAGCTTGCCGAGCCTGGTGTTCTCGTCCATCGCGGCCAGCAATACCAGCTCGCTGGAGATGAACTG
GTCGCCCTTCTGCTGGGCCAGGCGGTCAGCCTGGTTGAGCAGGCGTGCGAGATCCTGGGACAGGTTCACGTCGCCGGTCG
GGCTCTGGATCTTCGGCAGCGCGTCGAGTTCTTTGTTGAGGCCGCTGCGCAGGGCGGCGATATCGAAGCCGACCTGCATC
AGCAGGGGCTTGATCGAACCGCCTTGCTGCTCGAGCAGGGCGGAAAGCAGGTGCACCGGCTCGATGGCCGGATGGTCATG
GCCAACGGCCAGGGACTGGGCGTCGGAGAGCGCCAGTTGCAGCTTGCTGGTCAAACGGTCTATTCGCATGGGTCGTCCTT
CCTTCTATAG

>ORF23367 (SEQ ID NO:274)
GCTATCGCGGAACGTCTTTCTTCCAACCCTGGACGCTTCCGGTGTTGCTGGATTCGCGTCTCAGAGGCGCGCCATTTTAC
GGATGCGCGCGGGCATGTCAACCCTCTGATCCAAAAAGTTTTTCTTCTTTTTCCACGAGCGACAAAACGGCCCTTCCACT
GCATGCGGCAGCGCTCTCGCGCCTACCGGACGCCCATGAAAAAGCCCCGCCGAAGCGGGGCTTTCCCTGTCCGCCCCCGA
AGAGGTCAGGCGAAGACGATCTCGTCGCCTTCCACCTTCGCCGAGATACTGGCACCCGGCGCGAATTTGCCGGCCAGGAT
CAGTTGCGCCAGCGGGTTCTCGATCCAGCGCTGGATGGCCCGCTTCAGCGGGCGTGCGCCATAG

Fig. 3-20

>ORF25103c (SEQ ID NO:276)
AGTGCACCACGGGGTGAGCATCACCGACGGCGCGATCATCGCCGCGGCCAAGCTGTCGCACCGCTACATCACCGATCGGC
AACTGCCGGACAAGGCCATCGACCTGATCGACGAGGCCGCCAGCCGCATCCGCATGGAGATCGACTCCAAGCCGGAGGAA
CTGGATCGTCTCGACCGTCGCCTGATCCAGCTGAAGATCGAGCGCGAGGCGCTGAAGAAGGAAGACGACGAAGCCACCAG
GAAGCGCCTGGCCAAGCTGGAGGAGGATATCGTCAAGCTCGAGCGCGAATACGCCGACCTCGAGGAGATCTGGAAGTCCG
AGAAGGCCGAGGTGCAGGGCTCGGCGCAGATCCAGCAGAAGATCGAGCAGGCCAAGCAGGAGATGGAGGCGGCGCGGCGC
AAGGGCGACCTCGAGAGCATGGCGCGCATCCAGTACCAGACCATCCCGGACCTGGAACGCAGCCTGCAGATGGTCGACCA
GCACGGCAAGACCGAGAACCAGTTGCTGCGCAACAAGGTGACCGACGAGGAAATCGCCGAAGTGGTTTCCAAGTGGACCG
GTATCCCGGTGTCGAAGATGCTCGAGGGCGAGCGCGAGAAGCTGCTGCGCATGGAGCAGGAGCTGCATCGGCGAGTGATC
GGCCAGGACGAGGCGGTAGTCGCCGTGTCCAACGCCGTGCGCCGTTCGCGCGCCGGCCTCGCCGATCCGAACCGGCCGAG
CGGCTCGTTCCTCTTCCTCGGCCCGACCGGGGTGGGCAAGACCGAGTTGTGCAAGGCGCTGGCCGAGTTCCTCTTCGATA
CCGAGGAGGCGCTGGTGCGGATAGATATGTCCGAGTTCATGGAGAAACACTCGGTGGCCCGCCTGATCGGCGCGCCTCCG
GGCTACGTCGGCTTCGAGGAAGGCGGCTACCTGACCGAGGCGATCCGCCGCAAGCCCTACTCGGTGGTGCTGCTGGACGA
GGTGGAGAAGGCCCATCCGGATGTATTCAACATTCTCCTCCAGGTGCTCGAGGACGGACGCCTGACCGACAGTCACGGGC
GTACGGTGGACTTCCGCAACACCGTGGTGGTGATGACCTCCAACCTCGGTTCGGCGCAGATCCAGGAGCTGGCCGGCGAC
CGCGAGGCGCAACGTGCCGCAGTGATGGACGCGGTCAATGCGCACTTCCGTCCGGAATTCATCAACCGGATCGACGAAGT
GGTGGTGTTCGAGCCGCTGGCTCGCGAGCAGATCGCCGGCATCGCCGAGATCCAGCTCGGTCGCCTGCGCAAGCGCCTGG
CCGAGCGCGAGCTGAGCCTGGAACTGAGCCAGGAGGCGCTGGACAAGCTGATTGCCGTCGGCTTCGACCCGGTCTATGGC
GCACGCCCGCTGAAGCGGGCCATCCAGCGCTGGATCGAGAACCCGCTGGCGCAACTGATCCTGGCCGGCAAATTCGCGCC
GGGTGCCAGTATCTCGGCGAAGGTGGAAGGCGACGAGATCGTCTTCGCCTGACCTCTTCGGGGGCGGACAGGGAAAGCCC
CGCTTCGGCGGGGCTTTTTCATGGGCGTCCGGTAGGCGCGAGAGCGCTGCCGCATGCAGTGGAAGGGCCGTTTTGTCGCT
CGTGGAAAAAGAAGAAAAACTTTTTGGATCAGAGGGTTGACATGCCCGCGCGCATCCGTAAAATGGCGCGCCTCTGA

>ORF23556 (SEQ ID NO:278)
AAAAGCCCCGCCGAAGCGGGGCTTTCCCTGTCCGCCCCCGAAGAGGTCAGGCGAAGACGATCTCGTCGCCTTCCACCTTC
GCCGAGATACTGGCACCCGGCGCGAATTTGCCGGCCAGGATCAGTTGCGCCAGCGGGTTCTCGATCCAGCGCTGGATGGC
CCGCTTCAGCGGGCGTGCGCCATAGACCGGGTCGAAGCCGACGGCAATCAGCTTGTCCAGCGCCTCCTGGCTCAGTTCCA
GGCTCAGCTCGCGCTCGGCCAGGCGCTTGCGCAGGCGACCGAGCTGGATCTCGGCGATGCCGGCGATCTGCTCGCGAGCC
AGCGGCTCGAACACCACCACTTCGTCGATCCGGTTGA

Fig. 3-21

>ORF26191c (SEQ ID NO:280)
AAGGAAGGACGACCCATGCGAATAGACCGTTTGACCAGCAAGCTGCAACTGGCGCTCTCCGACGCCCAGTCCCTGGCCGT
TGGCCATGACCATCCGGCCATCGAGCCGGTGCACCTGCTTTCCGCCCTGCTCGAGCAGCAAGGCGGTTCGATCAAGCCCC
TGCTGATGCAGGTCGGCTTCGATATCGCCGCCCTGCGCAGCGGCCTCAACAAAGAACTCGACGCGCTGCCGAAGATCCAG
AGCCCGACCGGCGACGTGAACCTGTCCCAGGATCTCGCACGCCTGCTCAACCAGGCTGACCGCCTGGCCCAGCAGAAGGG
CGACCAGTTCATCTCCAGCGAGCTGGTATTGCTGGCCGCGATGGACGAGAACACCAGGCTCGGCAAGCTGCTGCTCGGCC
AGGGCGTGTCGCGCAAGGCGCTGGAGAATGCCGTGGCCAACCTGCGTGGCGGCGAAGCGGTGAACGACCCGAACGTCGAG
GAGTCGCGCCAGGCGCTGGACAAGTACACCGTCGACATGACCAAGCGCGCCGAGGAAGGCAAGCTCGACCCGGTGATCGG
TCGCGACGACGAGATCCGCCGGACCATCCAGGTCCTGCAGCGGCGGACCAAGAACAACCCGGTGCTGATCGGCGAACCCG
GCGTCGGCAAGACCGCCATCGTCGAGGGCCTGGCCCAGCGCATCATCAACGGCGAAGTGCCGGACGGCCTCAAGGACAAG
CGCCTGCTGGCCCTGGACATGGGGGCGCTGATCGCCGGTGCCAAGTTCCGCGGCGAGTTCGAGGAACGCCTGAAGGCGGT
CCTCAACGAACTGGGCAAGCAGGAAGGCCGGGTCATCCTGTTCATCGACGAACTGCACACCATGGTCGGCGCCGGCAAGG
CGGAAGGTGCCATGGACGCCGGCAACATGCTCAAGCCGGCTCTGGCGCGCGGCGAGCTGCACTGCGTCGGTGCTACTACC
CTCGACGAGTATCGCCAGTACATCGAGAAGGATGCCGCGCTGGAGCGCCGCTTCCAGAAGGTGCTGGTGGACGAACCGAG
CGAGGAAGACACCATCGCCATCCTCCGTGGCCTCAAGGAACGCTATGAAGTGCACCACGGGGTGAGCATCACCGACGGCG
CGATCATCGCCGCGGCCAAGCTGTCGCACCGCTACATCACCGATCGGCAACTGCCGGACAAGGCCATCGACCTGATCGAC
GAGGCCGCCAGCCGCATCCGCATGGAGATCGACTCCAAGCCGGAGGAACTGGATCGTCTCGACCGTCGCCTGATCCAGCT
GAAGATCGAGCGCGAGGCGCTGAAGAAGGAAGACGACGAAGCCACCAGGAAGCGCCTGGCCAAGCTGGAGGAGGATATCG
TCAAGCTCGAGCGCGAATACGCCGACCTCGAGGAGATCTGGAAGTCCGAGAAGGCCGAGGTGCAGGGCTCGGCGCAGATC
CAGCAGAAGATCGAGCAGGCCAAGCAGGAGATGGAGGCGGCGCGGCGCAAGGGCGACCTCGAGAGCATGGCGCGCATCCA
GTACCAGACCATCCCGGACCTGGAACGCAGCCTGCAGATGGTCGACCAGCACGGCAAGACCGAGAACCAGTTGCTGCGCA
ACAAGGTGACCGACGAGGAAATCGCCGAAGTGGTTTCCAAGTGGACCGGTATCCCGGTGTCGAAGATGCTCGAGGGCGAG
CGCGAGAAGCTGCTGCGCATGGAGCAGGAGCTGCATCGGCGAGTGATCGGCCAGGACGAGGCGGTAGTCGCCGTGTCCAA
CGCCGTGCGCCGTTCGCGCGCCGGCCTCGCCGATCCGAACCGGCCGAGCGGCTCGTTCCTCTTCCTCGGCCCGACCGGGG
TGGGCAAGACCGAGTTGTGCAAGGCGCTGGCCGAGTTCCTCTTCGATACCGAGGAGGCGCTGGTGCGGATAGATATGTCC
GAGTTCATGGAGAAACACTCGGTGGCCCGCCTGATCGGCGCGCCTCCGGGCTACGTCGGCTTCGAGGAAGGCGGCTACCT
GACCGAGGCGATCCGCCGCAAGCCCTACTCGGTGGTGCTGCTGGACGAGGTGGAGAAGGCCCATCCGGATGTATTCAACA
TTCTCCTCCAGGTGCTCGAGGACGGACGCCTGACCGACAGTCACGGGCGTACGGTGGACTTCCGCAACACCGTGGTGGTG
ATGACCTCCAACCTCGGTTCGGCGCAGATCCAGGAGCTGGCCGGCGACCGCGAGGCGCAACGTGCCGCAGTGATGGACGC
GGTCAATGCGCACTTCCGTCCGGAATTCATCAACCGGATCGACGAAGTGGTGGTGTTCGAGCCGCTGGCTCGCGAGCAGA
TCGCCGGCATCGCCGAGATCCAGCTCGGTCGCCTGCGCAAGCGCCTGGCCGAGCGCGAGCTGAGCCTGGAACTGAGCCAG
GAGGCGCTGGACAAGCTGATTGCCGTCGGCTTCGACCCGGTCTATGGCGCACGCCCGCTGAAGCGGGCCATCCAGCGCTG
GATCGAGAACCCGCTGGCGCAACTGATCCTGGCCGGCAAATTCGCGCCGGGTGCCAGTATCTCGGCGAAGGTGGAAGGCG
ACGAGATCGTCTTCGCCTGA

>ORF23751 (SEQ ID NO:282)
ACCGGGTCGAAGCCGACGGCAATCAGCTTGTCCAGCGCCTCCTGGCTCAGTTCCAGGCTCAGCTCGCGCTCGGCCAGGCG
CTTGCGCAGGCGACCGAGCTGGATCTCGGCGATGCCGGCGATCTGCTCGCGAGCCAGCGGCTCGAACACCACCACTTCGT
CGATCCGGTTGATGAATTCCGGACGGAAGTGCGCATTGACCGCGTCCATCACTGCGGCACGTTGCGCCTCGCGGTCGCCG
GCCAGCTCCTGGATCTGCGCCGAACCGAGGTTGGAGGTCATCACCACCACGGTGTTGCGGAAGTCCACCGTACGCCCGTG
A

>ORF24222 (SEQ ID NO:284)
CCCGGAGGCGCGCCGATCAGGCGGGCCACCGAGTGTTTCTCCATGAACTCGGACATATCTATCCGCACCAGCGCCTCCTC
GGTATCGAAGAGGAACTCGGCCAGCGCCTTGCACAACTCGGTCTTGCCCACCCCGGTCGGGCCGAGGAAGAGGAACGAGC
CGCTCGGCCGGTTCGGATCGGCGAGGCCGGCGCGCAACGGCGCACGGCGTTGGACACGGCGACTACCGCCTCGTCCTGG
CCGATCACTCGCCGATGCAGCTCCTGCTCCATGCGCAGCAGCTTCTCGCGCTCGCCCTCGAGCATCTTCGACACCGGGAT
ACCGGTCCACTTGGAAACCACTTCGGCGATTTCCTCGTCGGTCACCTTGTTGCGCAGCAACTGGTTCTCGGTCTTGCCGT
GCTGGTCGACCATCTGCAGGCTGCGTTCCAGGTCCGGGATGGTCTGGTACTGGATGCGCGCCATGCTCTCGAGGTCGCCC
TTGCGCCGCGCCGCCTCCATCTCCTGCTTGGCCTGCTCGATCTTCTGCTGGATCTGCGCCGAGCCCTGCACCTCGGCCTT
CTCGGACTTCCAGATCTCCTCGAGGTCGGCGTATTCGCGCTCGAGCTTGACGATATCCTCCTCCAGCTTGGCCAGGCGCT
TCCTGGTGGCTTCGTCGTCTTCCTTCTTCAGCGCCTCGCGCTCGATCTTCAGCTGGATCAGGCGACGGTCGAGACGATCC
AGTTCCTCCGGCTTGGAGTCGATCTCCATGCGGATGCGGCTGGCGGCCTCGTCGATCAGGTCGATGGCCTTGTCCGGCAG
TTGCCGATCGGTGATGTAG

Fig. 3-22

>ORF24368 (SEQ ID NO:286)
ACTCGGACATATCTATCCGCACCAGCGCCTCCTCGGTATCGAAGAGGAACTCGGCCAGCGCCTTGCACAACTCGGTCTTG
CCCACCCCGGTCGGGCCGAGGAAGAGGAACGAGCCGCTCGGCCGGTTCGGATCGGCGAGGCCGGCGCGCGAACGGCGCAC
GGCGTTGGACACGGCGACTACCGCCTCGTCCTGGCCGATCACTCGCCGATGCAGCTCCTGCTCCATGCGCAGCAGCTTCT
CGCGCTCGCCCTCGAGCATCTTCGACACCGGGATACCGGTCCACTTGGAAACCACTTCGGCGATTTCCTCGTCGGTCACC
TTGTTGCGCAGCAACTGGTTCTCGGTCTTGCCGTGCTGGTCGACCATCTGCAGGCTGCGTTCCAGGTCCGGGATGGTCTG
GTACTGGATGCGCGCCATGCTCTCGAGGTCGCCCTTGCGCCGCGCCGCCTCCATCTCCTGCTTGGCCTGCTCGATCTTCT
GCTGGATCTGCGCCGAGCCCTGCACCTCGGCCTTCTCGGACTTCCAGATCTCCTCGAGGTCGGCGTATTCGCGCTCGAGC
TTGA

>ORF24888c (SEQ ID NO:288)
AGAAGGAAGACGACGAAGCCACCAGGAAGCGCCTGGCCAAGCTGGAGGAGGATATCGTCAAGCTCGAGCGCGAATACGCC
GACCTCGAGGAGATCTGGAAGTCCGAGAAGGCCGAGGTGCAGGGCTCGGCGCAGATCCAGCAGAAGATCGAGCAGGCCAA
GCAGGAGATGGAGGCGGCGCGGCGCAAGGGCGACCTCGAGAGCATGGCGCGCATCCAGTACCAGACCATCCCGGACCTGG
AACGCAGCCTGCAGATGGTCGACCAGCACGGCAAGACCGAGAACCAGTTGCTGCGCAACAAGGTGA

>ORF25398c (SEQ ID NO:290)
AGGCGGTCCTCAACGAACTGGGCAAGCAGGAAGGCCGGGTCATCCTGTTCATCGACGAACTGCACACCATGGTCGGCGCC
GGCAAGGCGGAAGGTGCCATGGACGCCGGCAACATGCTCAAGCCGGCTCTGGCGCGCGGCGAGCTGCACTGCGTCGGTGC
TACTACCCTCGACGAGTATCGCCAGTACATCGAGAAGGATGCCGCGCTGGAGCGCCGCTTCCAGAAGGTGCTGGTGGACG
AACCGAGCGAGGAAGACACCATCGCCATCCTCCGTGGCCTCAAGGAACGCTATGAAGTGCACCACGGGGTGA

>ORF25892c (SEQ ID NO:292)
CCGCCTGGCCCAGCAGAAGGGCGACCAGTTCATCTCCAGCGAGCTGGTATTGCTGGCCGCGATGGACGAGAACACCAGGC
TCGGCAAGCTGCTGCTCGGCCAGGGCGTGTCGCGCAAGGCGCTGGAGAATGCCGTGGCCAACCTGCGTGGCGGCGAAGCG
GTGAACGACCCGAACGTCGAGGAGTCGCGCCAGGCGCTGGACAAGTACACCGTCGACATGACCAAGCGCGCCGAGGAAGG
CAAGCTCGACCCGGTGATCGGTCGCGACGACGAGATCCGCCGGACCATCCAGGTCCTGCAGCGGCGGACCAAGAACAACC
CGGTGCTGATCGGCGAACCCGGCGTCGGCAAGACCGCCATCGTCGAGGGCCTGGCCCAGCGCATCATCAACGGCGAAGTG
CCGGACGGCCTCAAGGACAAGCGCCTGCTGGCCCTGGACATGGGGGCGCTGATCGCCGGTGCCAAGTTCCGCGGCGAGTT
CGAGGAACGCCTGAAGGCGGTCCTCAACGAACTGGGCAAGCAGGAAGGCCGGGTCATCCTGTTCATCGACGAACTGCACA
CCATGGTCGGCGCCGGCAAGGCGGAAGGTGCCATGGACGCCGGCAACATGCTCAAGCCGGCTCTGGCGCGCGGCGAGCTG
CACTGCGTCGGTGCTACTACCCTCGACGAGTATCGCCAGTACATCGAGAAGGATGCCGCGCTGGAGCGCCGCTTCCAGAA
GGTGCTGGTGGACGAACCGAGCGAGGAAGACACCATCGCCATCCTCCGTGGCCTCAAGGAACGCTATGA

>ORF25110 (SEQ ID NO:294)
CGTTCCTTGAGGCCACGGAGGATGGCGATGGTGTCTTCCTCGCTCGGTTCGTCCACCAGCACCTTCTGGAAGCGGCGCTC
CAGCGCGGCATCCTTCTCGATGTACTGGCGATACTCGTCGAGGGTAGTAGCACCGACGCAGTGCAGCTCGCCGCGCGCCA
GAGCCGGCTTGAGCATGTTGCCGGCGTCCATGGCACCTTCCGCCTTGCCGGCGCCGACCATGGTGTGCAGTTCGTCGATG
AACAGGATGACCCGGCCTTCCTGCTTGCCCAGTTCGTTGAGGACCGCCTTCAGGCGTTCCTCGAACTCGCCGCGGAACTT
GGCACCGGCGATCAGCGCCCCCATGTCCAGGGCCAGCAGGCGCTTGTCCTTGAGGCCGTCCGGCACTTCGCCGTTGATGA
TGCGCTGGGCCAGGCCCTCGACGATGGCGGTCTTGCCGACGCCGGGTTCGCCGATCAGCACCGGGTTGTTCTTGGTCCGC
CGCTGCAGGACCTGGATGGTCCGGCGGATCTCGTCGTCGCGACCGATCACCGGGTCGAGCTTGCCTTCCTCGGCGCGCTT
GGTCATGTCGACGGTGTACTTGTCCAGCGCCTGGCGCGACTCCTCGACGTTCGGGTCGTTCACCGCTTCGCCGCCACGCA
GGTTGGCCACGGCATTCTCCAGCGCCTTGCGCGACACGCCCTGGCCGAGCAGCAGCTTGCCGAGCCTGGTGTTCTCGTCC
ATCGCGGCCAGCAATACCAGCTCGCTGGAGATGAACTGGTCGCCCTTCTGCTGGGCCAGGCGGTCAGCCTGGTTGAGCAG
GCGTGCGAGATCCTGGGACAGGTTCACGTCGCCGGTCGGGCTCTGGATCTTCGGCAGCGCGTCGAGTTCTTTGTTGAGGC
CGCTGCGCAGGGCGGCGATATCGAAGCCGACCTGCATCAGCAGGGGCTTGATCGAACCGCCTTGCTGCTCGAGCAGGGCG
GAAAGCAGGTGCACCGGCTCGATGGCCGGATGGTCATGGCCAACGGCCAGGGACTGGGCGTCGGAGAGCGCCAGTTGCAG
CTTGCTGGTCAAACGGTCTATTCGCATGGGTCGTCCTTCCTTCTATAGAGCGGGCCGGAACGATGGGTGTCCCTGA

>ORF25510 (SEQ ID NO:296)
TGCGCTGGGCCAGGCCCTCGACGATGGCGGTCTTGCCGACGCCGGGTTCGCCGATCAGCACCGGGTTGTTCTTGGTCCGC
CGCTGCAGGACCTGGATGGTCCGGCGGATCTCGTCGTCGCGACCGATCACCGGGTCGAGCTTGCCTTCCTCGGCGCGCTT
GGTCATGTCGACGGTGTACTTGTCCAGCGCCTGGCGCGACTCCTCGACGTTCGGGTCGTTCACCGCTTCGCCGCCACGCA
GGTTGGCCACGGCATTCTCCAGCGCCTTGCGCGACACGCCCTGGCCGAGCAGCAGCTTGCCGAGCCTGGTGTTCTCGTCC
ATCGCGGCCAGCAATACCAGCTCGCTGGAGATGA

Fig. 3-23

>ORF26762c (SEQ ID NO:298)
CCGCCGACTGCCTGCCGGCGTTGTTCTGCGACCGCTCGGGCACCCGGGTGGCCGCGGCCCATGCCGGCTGGCGCGGGCTG
GCGGCGGGCGTGCTGGAGGCGACGGTGGACAGCCTGGGCGTGCCCGGCGACGAACTGCTGGTCTGGCTGGGGCCGGCGAT
CGGCCCGCAGGCCTTCGAGGTCGGCGGCGAGGTCCGCGATGCATTCGTCGCTGCGCACGCCGAGGCGCGCTCGGCTTTCG
TACCTAGCGCCAATCCGGGCCGCTTCATGGCCGACATCTACCGACTCGCGCGGATCCGCCTGGGCGCCCATGGCGTCACC
GCCGTGCATGGCGGCGGCTTCTGCACCTTCAGCGATACCGCGCGCTTCTATTCCTACCGCCGCTCGTCGCGTACCGGCCG
TTTTGCCAGCCTGGTCTGGCTCCAGGACTAGGCCCGCGCAGGTTATCCGGCGGCAACTGACCGATGTCACGGTCCGGTCG
CTTGAACCGCGGAAAATCGCCCTTATCTACTGA

>ORF26257 (SEQ ID NO:300)
ATAAGGGCGATTTTCCGCGGTTCAAGCGACCGGACCGTGACATCGGTCAGTTGCCGCCGGATAACCTGCGCGGGCCTAGT
CCTGGAGCCAGACCAGGCTGGCAAAACGGCCGGTACGCGACGAGCGGCGGTAGGAATAGAAGCGCGCGGTATCGCTGAAG
GTGCAGAAGCCGCCGCCATGCACGGCGGTGACGCCATGGGCGCCCAGGCGGATCCGCGCGAGTCGGTAGATGTCGGCCAT
GAAGCGGCCCGGATTGGCGCTAGGTACGAAAGCCGAGCGCGCCTCGGCGTGCGCAGCGACGAATGCATCGCGGACCTCGC
CGCCGACCTCGAAGGCCTGCGGGCCGATCGCCGGCCCCAGCCAGACCAGCAGTTCGTCGCCGGGCACGCCCAGGCTGTCC
ACCGTCGCCTCCAGCACGCCCGCCGCCAGCCCGCGCCAGCCGGCATGGGCCGCGGCCACCCGGGTGCCCGAGCGGTCGCA
GAACAACGCCGGCAGGCAGTCGGCGGTCATGATCGTACAGGCGACGCCCGGCATCGCGCTCCAGCTGGCGTCGGCCCTGA
GCACCGGTTCGGGTCGGCCTCCACCACGTCACTCCGTGCACCTATTCCAACCAGCTCGGCCGGCATTCCAGACGCTCGGT
CAGGCGTCGGCGGTTTTATTCCACGGCGCGCGGATCGTCGTAGACGTGGGCGCCAAGGTTCAGACTGTCGAAGGGTGCCT
GGCTGA

>ORF26844c (SEQ ID NO:302)
CGTGGTGGAGGCCGACCCGAACCGGTGCTCAGGGCCGACGCCAGCTGGAGCGCGATGCCGGGCGTCGCCTGTACGATCAT
GACCGCCGACTGCCTGCCGGCGTTGTTCTGCGACCGCTCGGGCACCCGGGTGGCCGCGGCCCATGCCGGCTGGCGCGGGC
TGGCGGCGGGCGTGCTGGAGGCGACGGTGGACAGCCTGGGCGTGCCCGGCGACGAACTGCTGGTCTGGCTGGGGCCGGCG
ATCGGCCCGCAGGCCTTCGAGGTCGGCGGCGAGGTCCGCGATGCATTCGTCGCTGCGCACGCCGAGGCGCGCTCGGCTTT
CGTACCTAGCGCCAATCCGGGCCGCTTCATGGCCGACATCTACCGACTCGCGCGGATCCGCCTGGGCGCCCATGGCGTCA
CCGCCGTGCATGGCGGCGGCTTCTGCACCTTCAGCGATACCGCGCGCTTCTATTCCTACCGCCGCTCGTCGCGTACCGGC
CGTTTTGCCAGCCTGGTCTGGCTCCAGGACTAG

>ORF26486 (SEQ ID NO:304)
ATGTCGGCCATGAAGCGGCCCGGATTGGCGCTAGGTACGAAAGCCGAGCGCGCCTCGGCGTGCGCAGCGACGAATGCATC
GCGGACCTCGCCGCCGACCTCGAAGGCCTGCGGGCCGATCGCCGGCCCCAGCCAGACCAGCAGTTCGTCGCCGGGCACGC
CCAGGCTGTCCACCGTCGCCTCCAGCACGCCCGCCGCCAGCCCGCGCCAGCCGGCATGGGCCGCGGCCACCCGGGTGCCC
GAGCGGTCGCAGAACAACGCCGGCAGGCAGTCGGCGGTCATGATCGTACAGGCGACGCCCGGCATCGCGCTCCAGCTGGC
GTCGGCCCTGAGCACCGGTTCGGGTCGGCCTCCACCACGTCACTCCGTGCACCTATTCCAACCAGCTCGGCCGGCATTCC
AGACGCTCGGTCAGGCGTCGGCGGTTTTATTCCACGGCGCGCGGATCGTCGTAGACGTGGGCGCCAAGGTTCAGACTGTC
GAAGGGTGCCTGGCTGACCCCGCCACTGCGCGTGGTCACGCAGGCCCGCACACGGGCCGGCGCCGGCCAGTCGGGGGTCA
GCCAGGCGTTCAACCGACGAACGCCTCGCGATCCTGGCGCAACAGGCTGAGCAGCCAGAGGAATTCTTCCGGCAGCGGCG
ATTCCCACTTCATGCGCACGCCGGTGGCCGGGTGA

>ORF26857c (SEQ ID NO:306)
GTGCACGGAGTGACGTGGTGGAGGCCGACCCGAACCGGTGCTCAGGGCCGACGCCAGCTGGAGCGCGATGCCGGGCGTCG
CCTGTACGATCATGACCGCCGACTGCCTGCCGGCGTTGTTCTGCGACCGCTCGGGCACCCGGGTGGCCGCGGCCCATGCC
GGCTGGCGCGGGCTGGCGGCGGGCGTGCTGGAGGCGACGGTGGACAGCCTGGGCGTGCCCGGCGACGAACTGCTGGTCTG
GCTGGGGCCGGCGATCGGCCCGCAGGCCTTCGAGGTCGGCGGCGAGGTCCGCGATGCATTCGTCGCTGCGCACGCCGAGG
CGCGCTCGGCTTTCGTACCTAG

>ORF27314c (SEQ ID NO:308)
AGTGGGAATCGCCGCTGCCGGAAGAATTCCTCTGGCTGCTCAGCCTGTTGCGCCAGGATCGCGAGGCGTTCGTCGGTTGA
ACGCCTGGCTGACCCCCGACTGGCCGGCGCCGGCCCGTGTGCGGGCCTGCGTGACCACGCGCAGTGGCGGGGTCAGCCAG
GCACCCTTCGACAGTCTGAACCTTGGCGCCCACGTCTACGACGATCCGCGCGCCGTGGAATAAAACCGCCGACGCCTGAC
CGAGCGTCTGGAATGCCGGCCGAGCTGGTTGGAATAGGTGCACGGAGTGACGTGGTGGAGGCCGACCCGAACCGGTGCTC
AGGGCCGACGCCAGCTGGAGCGCGATGCCGGGCGTCGCCTGTACGATCATGA

Fig. 3-24

>ORF27730c (SEQ ID NO:310)
CAAGCCCGCCGGCCTGGTGGTCCATCCGGCTGCCGGCCATCAGGACGGCACCCTGCTGAATGCCTTGCTCTACCATGTCC
CGGACATCGCCAATGTGCCGCGCGCCGGGATCGTCCACCGCCTGGACAAGGACACGACCGGCCTGATGGTAGTGGCCAAG
ACGCTGGAGCCCACACCAAGCTGGTGGCGCAACTGCAGGCACGGTCGGTCAGCCGCATCTACGAGGCGATCGTGATCGG
CGTGATCACCTCCGGCGGCACCATCGATGCGCCGATCGGACGGCATGGCGTGCAGCGGCAGAAGATGGCGGTGGTCGACG
CCGGCAAGGTGGCGGTCAGCCATTACCGCGTGCTGGAACGCTTCCGTGCGCACACCCATACCCGGGTCAAGCTGGAGACC
GGGCGTACCCACCAGATCCGCGTGCACATGAGCCATATTGGCTATCCCCTGGTCGGCGATCCGGTCTACGGTGGGCGCTT
CAGGATTCCCCCGGTGGCCAGCCAGACCCTGGTCCAGACTCTTCGCGAATTCCCCCGGCAGGCGCTGCACGCGCGCTTCC
TCGAACTGGATCACCCGGCCACCGGCGTGCGCATGAAGTGGGAATCGCCGCTGCCGGAAGAATTCCTCTGGCTGCTCAGC
CTGTTGCGCCAGGATCGCGAGGCGTTCGTCGGTTGAACGCCTGGCTGACCCCCGACTGGCCGGCGCCGGCCCGTGTGCGG
GCCTGCGTGACCACGCGCAGTGGCGGGGTCAGCCAGGCACCCTTCGACAGTCTGAACCTTGGCGCCCACGTCTACGACGA
TCCGCGCGCCGTGGAATAA

>ORF26983 (SEQ ID NO:312)
CCCCGCCACTGCGCGTGGTCACGCAGGCCCGCACACGGGCCGGCGCCGGCCAGTCGGGGGTCAGCCAGGCGTTCAACCGA
CGAACGCCTCGCGATCCTGGCGCAACAGGCTGAGCAGCCAGAGGAATTCTTCCGGCAGCGGCGATTCCCACTTCATGCGC
ACGCCGGTGGCCGGGTGATCCAGTTCGAGGAAGCGCGCGTGCAGCGCCTGCCGGGGGAATTCGCGAAGAGTCTGGACCAG
GGTCTGGCTGGCCACCGGGGAATCCTGAAGCGCCCACCGTAGACCGGATCGCCGACCAGGGGATAGCCAATATGGCTCA
TGTGCACGCGGATCTGGTGGGTACGCCCGGTCTCCAGCTTGACCCGGGTATGGGTGTGCGCACGGAAGCGTTCCAGCACG
CGGTAATGGCTGACCGCCACCTTGCCGGCGTCGACCACCGCCATCTTCTGCCGCTGCACGCCATGCCGTCCGATCGGCGC
ATCGATGGTGCCGCCGGAGGTGATCACGCCGATCACGATCGCCTCGTAGATGCGGCTGACCGACCGTGCCTGCAGTTGCG
CCACCAGCTTGGTGTGGGCCTCCAGCGTCTTGGCCACTACCATCAGGCCGGTCGTGTCCTTGTCCAGGCGGTGGACGATC
CCGGCGCGCGGCACATTGGCGATGTCCGGGACATGGTAGAGCAAGGCATTCAGCAGGGTGCCGTCCTGATGGCCGGCAGC
CGGATGGACCACCAGGCCGGCGGGCTTGTCAATCACCAGGATGTGCTCGTCCTCGTAGACGATTTCCAGCTCGATGTCCT
GTGCGAGCCACTCGCCCTGGGCTTCCTGCTCGGCCTCCAGGACCAGTTGCGCGCCGCTGTGGACGATGTCGCGCGGGCGC
AGCACGGCGCCGTCGACGGTCAGGCGACCGTCCTTGATCCAGCCGGCCAGACGGGAGCGGGAGTGTTCGGGAAAAAGCTG
GGCGGCGATCTGGTCGAGACGCTGGCCACCCAGCTCGAACGGCACCTCGGCCGCGCGTTGAATCATATCGGACATGAGTA
G

>ORF28068c (SEQ ID NO:314)
CCACAGCGCGTAGCCGATTCCAAAAGCCGCGCTGAGCATCGTCTCCTACTCATGTCCGATATGATTCAACGCGCGGCCGA
GGTGCCGTTCGAGCTGGGTGGCCAGCGTCTCGACCAGATCGCCGCCCAGCTTTTTCCCGAACACTCCCGCTCCCGTCTGG
CCGGCTGGATCAAGGACGGTCGCCTGACCGTCGACGGCGCCGTGCTGCGCCCGCGCGACATCGTCCACAGCGGCGCGCAA
CTGGTCCTGGAGGCCGAGCAGGAAGCCCAGGGCGAGTGGCTCGCACAGGACATCGAGCTGGAAATCGTCTACGAGGACGA
GCACATCCTGGTGATTGACAAGCCCGCCGGCCTGGTGGTCCATCCGGCTGCCGGCCATCAGGACGGCACCCTGCTGAATG
CCTTGCTCTACCATGTCCCGGACATCGCCAATGTGCCGCGCGCCGGGATCGTCCACCGCCTGGACAAGGACACGACCGGC
CTGATGGTAGTGGCCAAGACGCTGGAGGCCCACACCAAGCTGGTGGCGCAACTGCAGGCACGGTCGGTCAGCCGCATCTA
CGAGGCGATCGTGATCGGCGTGATCACCTCCGGCGGCACCATCGATGCGCCGATCGGACGGCATGGCGTGCAGCGGCAGA
AGATGGCGGTGGTCGACGCCGGCAAGGTGGCGGTCAGCCATTACCGCGTGCTGGAACGCTTCCGTGCGCACACCCATACC
CGGGTCAAGCTGGAGACCGGGCGTACCCACCAGATCCGCGTGCACATGAGCCATATTGGCTATCCCCTGGTCGGCGATCC
GGTCTACGGTGGGCGCTTCAGGATTCCCCGGTGGCCAGCCAGACCCTGGTCCAGACTCTTCGCGAATTCCCCCGGCAGG
CGCTGCACGCGCGCTTCCTCGAACTGGATCACCCGGCCACCGGCGTGCGCATGAAGTGGGAATCGCCGCTGCCGGAAGAA
TTCCTCTGGCTGCTCAGCCTGTTGCGCCAGGATCGCGAGGCGTTCGTCGGTTGA

>ORF27522 (SEQ ID NO:316)
CCGACCGTGCCTGCAGTTGCGCCACCAGCTTGGTGTGGGCCTCCAGCGTCTTGGCCACTACCATCAGGCCGGTCGTGTCC
TTGTCCAGGCGGTGGACGATCCCGGCGCGCGGCACATTGGCGATGTCCGGGACATGGTAGAGCAAGGCATTCAGCAGGGT
GCCGTCCTGATGGCCGGCAGCCGGATGGACCACCAGGCCGGCGGGCTTGTCAATCACCAGGATGTGCTCGTCCTCGTAGA
CGATTTCCAGCTCGATGTCCTGTGCGAGCCACTCGCCCTGGGCTTCCTGCTCGGCCTCCAGGACCAGTTGCGCGCCGCTG
TGGACGATGTCGCGCGGGCGCAGCACGGCGCCGTCGACGGTCAGGCGACCGTCCTTGA

Fig. 3-25

>ORF28033c (SEQ ID NO:318)
GCATCGTCTCCTACTCATGTCCGATATGATTCAACGCGCGGCCGAGGTGCCGTTCGAGCTGGGTGGCCAGCGTCTCGACC
AGATCGCCGCCCAGCTTTTTCCCGAACACTCCCGCTCCCGTCTGGCCGGCTGGATCAAGGACGGTCGCCTGACCGTCGAC
GGCGCCGTGCTGCGCCCGCGCGACATCGTCCACAGCGGCGCGCAACTGGTCCTGGAGGCCGAGCAGGAAGCCCAGGGCGA
GTGGCTCGCACAGGACATCGAGCTGGAAATCGTCTACGAGGACGAGCACATCCTGGTGATTGA

>ORF29701c (SEQ ID NO:320)
TCTTCCAGTTCGCTGGAGATCAGCAGGACCAGTACCAGGCCGATGGTCAGGCGGTACAGGTGGTACAGACGGAGGATGCG
TTGCCCCTGCTCCTCGCTCAGCCGTAGCCGTTCAGCGCGCACGGTCGCCCTGGTCCTGGCGCAGGTGCGCCTGGCTGCAA
TACCAGCGTTGTTCGTGGGCGAGGGCGTTGGCCTGCGGCACGTGGACGCCGCAATGGGCGCAGCGGACCATCGGCGATGC
GCTCGGCTCGTCCTGCGGACGTTGCTGCTGGCGCGGAGTGGGACGGGTAAAGCGACGCCAGAGCCAGAACGCGATGGCGA
TCAGGGCGATCCAGAACAGGAGCGGAAAAGGCCCATGGTGATCTCGGAGGCTGGAGAAAGCTGCAGTTTAGCCAAGCCG
CCGGCTCGATCCCAGACGGGAAGGTCCAGGCTGTGCGGCGTTTGGCGCTGGGAGAGGCATGGCGGCGGGCAAAAAGAAGG
GAGGCCTGCGCCTCCCTTCGGTGTTTCGTGCGATCAGTCGAAGAGACCGAAGGTCATGTAGCTCCACCAGGAGCGACCGG
AGTCCTCGTCGTCATCGCTCTCCGGCTTCTCGTCGTCGGCGCTGTGATCCTGGTTTTCCGGCTTCAGTTCGGCGGGGATC
TCCCGCTCGGCATCCTCGTACTGCTTGATCACGTCCTTGGCGGCCTGGGTTTCCATGTGCGGCGGCGGCTCGCCGCCTTC
GATCAGGCCCAGGGTGGCCTTGGCCAGCCAGGAGCGGGTGTCGGCCTCGCTTTCGCGGGCGACGAACTCGCCATCCTTGA
GGCTGGCGTTATCCGGATAGTTCAGCTTGAGGGTTTCCAGGCTGGTGCTGGCCAGGTCGTCGAGACCCAGGCGACGGTAG
GCTTCGACCATGATCGCCAGGCCATCGCCGACGGCCGGGGTTTCCTGGAAGTTCTCCACCACGTAGCGACCGCGGTTGGC
GGCGGCGACATAGGCCTGGCGCTTCAGGTAGTAGTGGCCGACGTGCACTTCGTAGGCCGCCAGCAGGTTGCGCAGGTACA
CCATGCGCGCCTTGGCGTCCGGGGCGTAGCGGCTGTTGGGGAAGCGGCTGGTGAGCTGGGCGAACTCGTTGAAGGAGTCG
CGGGCGGCGCCCGGGTCGCGCTTGGTCATGTCCAGCGGCAGGAAGCGCGCCAGCAGGCCGCGGTCCTGGTCGAAGGAGGA
CAGGCCTTTGAGGTAGTAGGCGTAGTCGACGTTGGGGTGCTGCGGATGCAGGCGGATGAAGCGTTCGGCGGCGGCGCGGG
CGGCTTCGGGCTCCATGTTCTTGTAGTTGGCGTAGATCAGCTCGAGCTGGGCCTGCTCGGCGTAGCGGCCGAAGGGATAG
CGCGATTCGAGGGCTTTTCAGCTTGGTGACGGCGCTGTTGTAGCTCTTGTTGTTGAGGTCGTCCTGCGCCTGCTGGTACAG
CTGGCTCTCGCTCAGGTTCTCGTCGACAGTCTCCTTGTTCGAGGAGCAGGCTGCGGTGAGGGCGAGGATGGCGATCAGCA
GCAGGTGTTTCACTTGCATGGCGGCTTGCGTCCCTGGGACGGTCGGCTTGGCCTCAACCGTCTGTTATGA

>ORF28118 (SEQ ID NO:322)
CAGACGGTTGAGGCCAAGCCGACCGTCCCAGGGACGCAAGCCGCCATGCAAGTGAAACACCTGCTGCTGATCGCCATCCT
CGCCCTCACCGCAGCCTGCTCCTCGAACAAGGAGACTGTCGACGAGAACCTGAGCGAGAGCCAGCTGTACCAGCAGGCGC
AGGACGACCTCAACAACAAGAGCTACAACAGCGCCGTCACCAAGCTGAAAGCCCTCGAATCGCGCTATCCCTTCGGCCGC
TACGCCGAGCAGGCCCAGCTCGAGCTGATCTACGCCAACTACAAGAACATGGAGCCCGAAGCCGCCCGCGCCGCCGCCGA
ACGCTTCATCCGCCTGCATCCGCAGCACCCCAACGTCGACTACGCCTACTACCTCAAAGGCCTGTCCTCCTTCGACCAGG
ACCGCGGCCTGCTGGCGCGCTTCCTGCCGCTGGACATGACCAAGCGCGACCCGGGCGCCGCCCGCGACTCCTTCAACGAG
TTCGCCCAGCTCACCAGCCGCTTCCCCAACAGCCGCTACGCCCCGGACGCCAAGGCGCGCATGGTGTACCTGCGCAACCT
GCTGGCGGCCTACGAAGTGCACGTCGGCCACTACTACCTGAAGCGCCAGGCCTATGTCGCCGCCGCCAACCGCGGTCGCT
ACGTGGTGGAGAACTTCCAGGAAACCCCGGCCGTCGGCGATGGCCTGGCGATCATGGTCGAAGCCTACCGTCGCCTGGGT
CTCGACGACCTGGCCAGCACCAGCCTGGAAACCCTCAAGCTGAACTATCCGGATAACGCCAGCCTCAAGGATGGCGAGTT
CGTCGCCCGCGAAAGCGAGGCCGACACCCGCTCCTGGCTGGCCAAGGCCACCCTGGGCCTGATCGAAGGCGGCGAGCCGC
CGCCGCACATGGAAACCCAGGCCGCCAAGGACGTGATCAAGCAGTACGAGGATGCCGAGCGGGAGATCCCCGCCGAACTG
AAGCCGGAAAACCAGGATCACAGCGCCGACGACGAGAAGCCGGAGAGCGATGACGACGAGGACTCCGGTCGCTCCTGGTG
GAGCTACATGACCTTCGGTCTCTTCGACTGA

>ORF28129 (SEQ ID NO:324)
GGCCAAGCCGACCGTCCCAGGGACGCAAGCCGCCATGCAAGTGAAACACCTGCTGCTGATCGCCATCCTCGCCCTCACCG
CAGCCTGCTCCTCGAACAAGGAGACTGTCGACGAGAACCTGAGCGAGAGCCAGCTGTACCAGCAGGCGCAGGACGACCTC
AACAACAAGAGCTACAACAGCGCCGTCACCAAGCTGAAAGCCCTCGAATCGCGCTATCCCTTCGGCCGCTACGCCGAGCA
GGCCCAGCTCGAGCTGATCTACGCCAACTACAAGAACATGGAGCCCGAAGCCGCCCGCGCCGCCGCCGAACGCTTCATCC
GCCTGCATCCGCAGCACCCCAACGTCGACTACGCCTACTACCTCAAAGGCCTGTCCTCCTTCGACCAGGACCGCGGCCTG
CTGGCGCGCTTCCTGCCGCTGGACATGACCAAGCGCGACCCGGGCGCCGCCCGCGACTCCTTCAACGAGTTCGCCCAGCT
CACCAGCCGCTTCCCCAACAGCCGCTACGCCCCGGACGCCAAGGCGCGCATGGTGTACCTGCGCAACCTGCTGGCGGCCT
ACGAAGTGCACGTCGGCCACTACTACCTGAAGCGCCAGGCCTATGTCGCCGCCGCCAACCGCGGTCGCTACGTGGTGGAG
AACTTCCAGGAAACCCCGGCCGTCGGCGATGGCCTGGCGATCATGGTCGAAGCCTACCGTCGCCTGGGTCTCGACGACCT
GGCCAGCACCAGCCTGGAAACCCTCAAGCTGAACTATCCGGATAA

Fig. 3-26

>ORF29709c (SEQ ID NO:326)
GGACCTGATCTTCCAGTTCGCTGGAGATCAGCAGGACCAGTACCAGGCCGATGGTCAGGCGGTACAGGTGGTACAGACGG
AGGATGCGTTGCCCCTGCTCCTCGCTCAGCCGTAGCCGTTCAGCGCGCACGGTCGCCCTGGTCCTGGCGCAGGTGCGCCT
GGCTGCAATACCAGCGTTGTTCGTGGGCGAGGGCGTTGGCCTGCGGCACGTGGACGCCGCAATGGGCGCAGCGGACCATC
GGCGATGCGCTCGGCTCGTCCTGCGGACGTTGCTGCTGGCGCGGAGTGGGACGGGTAAAGCGACGCCAGAGCCAGAACGC
GATGGCGATCAGGGCGATCCAGAACAGGAGGCGGAAAAGGCCCATGGTGATCTCGGAGGCTGGAGAAAGCTGCAGTTTAG
CCAAGCCGCCGGCTCGATCCCAGACGGGAAGGTCCAGGCTGTGCGGCGTTTGGCGCTGGGAGAGGCATGGCGGCGGGCAA
AAAGAAGGGAGGCCTGCGCCTCCCTTCGGTGTTTCGTGCGATCAGTCGAAGAGACCGAAGGTCATGTAG

>ORF29189 (SEQ ID NO:328)
TCGCACGAAACACCGAAGGGAGGCGCAGGCCTCCCTTCTTTTTGCCCGCCGCCATGCCTCTCCCAGCGCCAAACGCCGCA
CAGCCTGGACCTTCCCGTCTGGGATCGAGCCGGCGGCTTGGCTAAACTGCAGCTTTCTCCAGCCTCCGAGATCACCATGG
GCCTTTTCCGCCTCCTGTTCTGGATCGCCCTGATCGCCATCGCGTTCTGGCTCTGGCGTCGCTTTACCCGTCCCACTCCG
CGCCAGCAGCAACGTCCGCAGGACGAGCCGAGCGCATCGCCGATGGTCCGCTGCGCCCATTGCGGCGTCCACGTGCCGCA
GGCCAACGCCCTCGCCCACGAACAACGCTGGTATTGCAGCCAGGCGCACCTGCGCCAGGACCAGGGCGACCGTGCGCGCT
GA

>ORF29382 (SEQ ID NO:330)
TCGCCATCGCGTTCTGGCTCTGGCGTCGCTTTACCCGTCCCACTCCGCGCCAGCAGCAACGTCCGCAGGACGAGCCGAGC
GCATCGCCGATGGTCCGCTGCGCCCATTGCGGCGTCCACGTGCCGCAGGCCAACGCCCTCGCCCACGAACAACGCTGGTA
TTGCAGCCAGGCGCACCTGCGCCAGGACCAGGGCGACCGTGCGCGCTGAACGGCTACGGCTGAGCGAGGAGCAGGGGCAA
CGCATCCTCCGTCTGTACCACCTGTACCGCCTGACCATCGGCCTGGTACTGGTCCTGCTGATCTCCAGCGAACTGGAAGA
TCAGGTCCTCAAGCTCGTCCACCCTGAACTGTTCCATGTCGGCAGTTGGTGCTACCTGGTCTTCAACATCCTGGTCGCGC
TGTTCCTGCCGCCGTCGCGGCAATTGCTGCCGATCTTCATCCTCGCGCTCACCGACGTGCTGATGCTTTGCGGCCTGTTC
TACGCAGGTGGCGGCGTACCCAGCGGCATCGGCAGCCTGCTGGTGGTGGCGGTGGCCATTGCCAACATCCTGCTGCGCGG
GCGCATCGGCCTGGTCATCGCGGCGGCGGCCAGCCTCGGCCTGCTCTACCTGACCTTCTTCCTCAGCCTGAGCAGTCCGG
ACGCCACCAACCACTACGTCCAGGCCGGCGGCCTCGGCACCCTGTGCTTCGCCGCCGCTGGTGATCCAGGCTCTGGTG
CGGCGCCAGGAGCAGACCGAAACGCTGGCCGAAGAACGCGCCGAGACGGTCGCCAACCTGGAGGAACTCAACGCATTGAT
CCTGCAGCGCATGCGCACCGGCATCCTCGTGGTCGATAGCCGTCAGGCCATCCTCCTCGCCAACCAGGCCGCCCTCGGCC
TGCTCAGGCAGGACGACGTGCAGGGCGCCAGCCTCGGCCGCCACAGCCCGATGCTGATGCACTGCATGAAGCAATGGCGC
CTGAATCCCAGCCTCCGTCCGCCGACGCTCAAGGTGGTGCCGGATGGCCCGACGGTGCAACCCAGCTTTATCAGCCTCAA
CCGCGAAGACGACCAGCACGTGCTGATCTTCCTCGAAGACATTTCGCAGATCGCCCAGCAGGCGCAGCAGATGAAGCTGG
CCGGTCTTGGCCGCCTGACCGCCGGCATCGCCCATGAGATCCGCAACCCGCTGGGCGCGATCAGCCACGCCGCCCAACTG
CTGCAGGAGTCAGAGGAACTGGATGCCCGGACCGACGCCTGACGCAGATCATCCAGGACCAGTCGAAGCGGATGAACCT
GGTCATCGAGAACGTCCTGCAGCTCTCCCGTCGCCGCCAGGCCGAACCGCAGCAGCTCGACCTGAAGGAGTGGCTTCAGC
GGTTCGTCGACGAATACCCCGGCAGGCTGCGCAACGACAGCCAACTGCACCTGCAGCTCGGTGCCGGCGACATCCAGACC
CGCATGGACCCACACCAGTTGAACCAGGTGCTGAGCAACCTGGTGCAGAACGGTCTTCGCTACAGCGCCCAGGCGCACGG
GCGCGGCCAGGTCTGGCTGAGCCTCGCGCGCGACCCGGAGAGCGACCTGCCGGTGCTGGAAGTCATCGACGACGGTCCCG
GCGTACCGGCGGACAAACTGAACAACCTGTTCGAACCCTTCTTTACTACAGAAAGCAAAGGCACCGGCCTGGGCCTCTAT
CTCTCCCGCGAACTCTGCGAGAGCAACCAGGCACGGATCGACTACCGCAATCGCGAGGAAGGCGGCGGCTGCTTCCGCAT
CACCTTCGCCCACCCGCGCAAACTCAGCTGA

Fig. 3-27

>ORF30590c (SEQ ID NO:332)
CTCCTGCAGCAGTTGGGCGGCGTGGCTGATCGCGCCCAGCGGGTTGCGGATCTCATGGGCGATGCCGGCGGTCAGGCGGC
CAAGACCGGCCAGCTTCATCTGCTGCGCCTGCTGGGCGATCTGCGAAATGTCTTCGAGGAAGATCAGCACGTGCTGGTCG
TCTTCGCGGTTGAGGCTGATAAAGCTGGGTTGCACCGTCGGGCCATCCGGCACCACCTTGAGCGTCGGCGGACGGAGGCT
GGGATTCAGGCGCCATTGCTTCATGCAGTGCATCAGCATCGGGCTGTGGCGGCCGAGGCTGGCGCCCTGCACGTCGTCCT
GCCTGAGCAGGCCGAGGGCGGCCTGGTTGGCGAGGAGGATGGCCTGACGGCTATCGACCACGAGGATGCCGGTGCGCATG
CGCTGCAGGATCAATGCGTTGAGTTCCTCCAGGTTGGCGACCGTCTCGGCGCGTTCTTCGGCCAGCGTTTCGGTCTGCTC
CTGGCGCCGCACCAGAGCCTGGATCACCAGCGCGGCGGCGAAGCACAGGGTGCCGAGGCCGCCGGCCTGGACGTAGTGGT
TGGTGGCGTCCGGACTGCTCAGGCTGAGGAAGAAGGTCAGGTAGAGCAGGCCGAGGCTGGCCGCCGCCGCGATGACCAGG
CCGATGCGCCCGCGCAGCAGGATGTTGGCAATGGCCACCGCCACCACCAGCAGGCTGCCGATGCCGCTGGGTACGCCGCC
ACCTGCGTAGAACAGGCCGCAAAGCATCAGCACGTCGGTGAGCGCGAGGATGAAGATCGGCAGCAATTGCCGCGACGGCG
GCAGGAACAGCGCGACCAGGATGTTGAAGACCAGGTAGCACCAACTGCCGACATGGAACAGTTCAGGGTGGACGAGCTTG
AGGACCTGATCTTCCAGTTCGCTGGAGATCAGCAGGACCAGTACCAGGCCGATGGTCAGGCGGTACAGGTGGTACAGACG
GAGGATGCGTTGCCCCTGCTCCTCGCTCAGCCGTAG

>ORF29729 (SEQ ID NO:334)
ACTGTTCCATGTCGGCAGTTGGTGCTACCTGGTCTTCAACATCCTGGTCGCGCTGTTCCTGCCGCCGTCGCGGCAATTGC
TGCCGATCTTCATCCTCGCGCTCACCGACGTGCTGATGCTTTGCGGCCTGTTCTACGCAGGTGGCGGCGTACCCAGCGGC
ATCGGCAGCCTGCTGGTGGTGGCGGTGGCCATTGCCAACATCCTGCTGCGCGGGCGCATCGGCCTGGTCATCGCGGCGGC
GGCCAGCCTCGGCCTGCTCTACCTGACCTTCTTCCTCAGCCTGAGCAGTCCGGACGCCACCAACCACTACGTCCAGGCCG
GCGGCCTCGGCACCCTGTGCTTCGCCGCCGCGCTGGTGATCCAGGCTCTGGTGCGGCGCCAGGAGCAGACCGAAACGCTG
GCCGAAGAACGCGCCGAGACGGTCGCCAACCTGGAGGAACTCAACGCATTGATCCTGCAGCGCATGCGCACCGGCATCCT
CGTGGTCGATAG

>ORF30221 (SEQ ID NO:336)
CCGTCAGGCCATCCTCCTCGCCAACCAGGCCGCCCTCGGCCTGCTCAGGCAGGACGACGTGCAGGGCGCCAGCCTCGGCC
GCCACAGCCCGATGCTGATGCACTGCATGAAGCAATGGCGCCTGAATCCCAGCCTCCGTCCGCCGACGCTCAAGGTGGTG
CCGGATGGCCCGACGGTGCAACCCAGCTTTATCAGCCTCAACCGCGAAGACGACCAGCACGTGCTGATCTTCCTCGAAGA
CATTTCGCAGATCGCCCAGCAGGCGCAGCAGATGAAGCTGGCCGGTCTTGGCCGCCTGACCGCCGGCATCGCCCATGA

>ORF30736c (SEQ ID NO:338)
AGCCACTCCTTCAGGTCGAGCTGCTGCGGTTCGGCCTGGCGGCGACGGGAGAGCTGCAGGACGTTCTCGATGACCAGGTT
CATCCGCTTCGACTGGTCCTGGATGATCTGCGTCAGGCGTCGGTCCGGGGCATCCAGTTCCTCTGACTCCTGCAGCAGTT
GGGCGGCGTGGCTGATCGCGCCCAGCGGGTTGCGGATCTCATGGGCGATGCCGGCGGTCAGGCGGCCAAGACCGGCCAGC
TTCATCTGCTGCGCCTGCTGGGCGATCTGCGAAATGTCTTCGAGGAAGATCAGCACGTGCTGGTCGTCTTCGCGGTTGAG
GCTGATAAAGCTGGGTTGCACCGTCGGGCCATCCGGCACCACCTTGAGCGTCGGCGGACGGAGGCTGGGATTCAGGCGCC
ATTGCTTCATGCAGTGCATCAGCATCGGGCTGTGGCGGCCGAGGCTGGCGCCCTGCACGTCGTCCTGCCTGAGCAGGCCG
AGGGCGGCCTGGTTGGCGAGGAGGATGGCCTGA

>ORF30539 (SEQ ID NO:340)
GATCCGCAACCCGCTGGGCGCGATCAGCCACGCCGCCCAACTGCTGCAGGAGTCAGAGGAACTGGATGCCCCGGACCGAC
GCCTGACGCAGATCATCCAGGACCAGTCGAAGCGGATGAACCTGGTCATCGAGAACGTCCTGCAGCTCTCCCGTCGCCGC
CAGGCCGAACCGCAGCAGCTCGACCTGAAGGAGTGGCTTCAGCGGTTCGTCGACGAATACCCCGGCAGGCTGCGCAACGA
CAGCCAACTGCACCTGCAGCTCGGTGCCGGCGACATCCAGACCCGCATGGACCCACACCAGTTGAACCAGGTGCTGAGCA
ACCTGGTGCAGAACGGTCTTCGCTACAGCGCCCAGGCGCACGGGCGCGGCCAGGTCTGGCTGAGCCTCGCGCGCGACCCG
GAGAGCGACCTGCCGGTGCTGGAAGTCATCGACGACGGTCCCGGCGTACCGGCGGACAAACTGAACAACCTGTTCGAACC
CTTCTTTACTACAGAAAGCAAAGGCACCGGCCTGGGCCTCTATCTCTCCCGCGAACTCTGCGAGAGCAACCAGGCACGGA
TCGACTACCGCAATCGCGAGGAAGGCGGCGGCTGCTTCCGCATCACCTTCGCCCACCCGCGCAAACTCAGCTGACGGAAG
CCGCACGCATGAGCCGACAAAAAGCCCTGATCGTCGACGATGAACCGGATATCCGCGAACTGCTGGAAATCACTCTCGGC
CGCATGAAGCTGGACACCCGCAGCGCCCGCAACGTCAAGGAAGCCGCGAGTTGCTGGCCCGCGAGCCGTTCGACCTGTGC
CTCACCGACATGCGCCTGCCGGACGGCAGCGGCCTCGATCTGGTCCAGTACATCCAGCAGCGCCATCCACAGACCCCGGT
GGCCATGA

Fig. 3-28

>ORF31247c (SEQ ID NO:342)
TTTCCAGCAGTTCGCGGATATCCGGTTCATCGTCGACGATCAGGGCTTTTTGTCGGCTCATGCGTGCGGCTTCCGTCAGC
TGAGTTTGCGCGGGTGGGCGAAGGTGATGCGGAAGCAGCCGCCGCCTTCCTCGCGATTGCGGTAGTCGATCCGTGCCTGG
TTGCTCTCGCAGAGTTCGCGGGAGAGATAGAGGCCCAGGCCGGTGCCTTTGCTTTCTGTAGTAAAGAAGGGTTCGAACAG
GTTGTTCAGTTTGTCCGCCGGTACGCCGGGACCGTCGTCGATGACTTCCAGCACCGGCAGGTCGCTCTCCGGGTCGCGCG
CGAGGCTCAGCCAGACCTGGCCGCGCCCGTGCGCCTGGGCGCTGTAGCGAAGACCGTTCTGCACCAGGTTGCTCAGCACC
TGGTTCAACTGGTGTGGGTCCATGCGGGTCTGGATGTCGCCGGCACCGAGCTGCAGGTGCAGTTGGCTGTCGTTGCGCAG
CCTGCCGGGGTATTCGTCGACGAACCGCTGAAGCCACTCCTTCAGGTCGAGCTGCTGCGGTTCGGCCTGGCGGCGACGGG
AGAGCTGCAGGACGTTCTCGATGACCAGGTTCATCCGCTTCGACTGGTCCTGGATGATCTGCGTCAGGCGTCGGTCCGGG
GCATCCAGTTCCTCTGA

>ORF30963c (SEQ ID NO:344)
CTTCCAGCACCGGCAGGTCGCTCTCCGGGTCGCGCGCGAGGCTCAGCCAGACCTGGCCGCGCCCGTGCGCCTGGGCGCTG
TAGCGAAGACCGTTCTGCACCAGGTTGCTCAGCACCTGGTTCAACTGGTGTGGGTCCATGCGGGTCTGGATGTCGCCGGC
ACCGAGCTGCAGGTGCAGTTGGCTGTCGTTGCGCAGCCTGCCGGGGTATTCGTCGACGAACCGCTGAAGCCACTCCTTCA
GGTCGAGCTGCTGCGGTTCGGCCTGGCGGCGACGGGAGAGCTGCAGGACGTTCTCGATGA

>ORF31539c (SEQ ID NO:346)
GGCGGTTGCCACCAGCTCCCGCAAGCGACCGAGGTCGACCGGTTTGGTGAGGAAGTCGAAGGCACCGGCCTTGAGCGCCT
GGATCGCGGTGTCCAGGCTGCCGTACGCGGTGATCATGGCCACCGGGGTCTGTGGATGGCGCTGCTGGATGTACTGGACC
AGATCGAGGCCGCTGCCGTCCGGCAGGCGCATGTCGGTGAGGCACAGGTCGAACGGCTCGCGGGCCAGCAACTCGCGGCT
TCCTTGACGTTGCGGGCGCTGCGGGTGTCCAGCTTCATGCGGCCGAGAGTGATTTCCAGCAGTTCGCGGATATCCGGTTC
ATCGTCGACGATCAGGGCTTTTTGTCGGCTCATGCGTGCGGCTTCCGTCAGCTGA

>ORF31222 (SEQ ID NO:348)
ACCGGATATCCGCGAACTGCTGGAAATCACTCTCGGCCGCATGAAGCTGGACACCCGCAGCGCCCGCAACGTCAAGGAAG
CCGCGAGTTGCTGGCCCGCGAGCCGTTCGACCTGTGCCTCACCGACATGCGCCTGCCGGACGGCAGCGGCCTCGATCTGG
TCCAGTACATCCAGCAGCGCCATCCACAGACCCCGGTGGCCATGATCACCGCGTACGGCAGCCTGGACACCGCGATCCAG
GCGCTCAAGGCCGGTGCCTTCGACTTCCTCACCAAACCGGTCGACCTCGGTCGCTTGCGGGAGCTGGTGGCAACCGCCCT
ACGCTTGCGCAACCCGGAAGCCGAGGAAGCGCCGGTGGACAACCGCCTGCTCGGCGAGTCGCCGCCGATGCGCGCCCTGC
GCAACCAGATCGGCAAGCTGGCGCGCAGCCAGGCGCCGGTCTACATCAGTGGCGAGTCCGGCAGCGGCAAGGAACTGGTG
GCGCGCCTGATCCACGAGCAGGGGCCACGTATCGAGCGGCCGTTCGTGCCGGTGAACTGCGGCGCGATTCCCTCCGAGCT
GATGGAAAGCGAGTTCTTCGGCCACAAGAAAGGCAGCTTCACTGGCGCTATCGAAGACAAGCAGGGCCTGTTCCAGGCCG
CCAGCGGTGGCACCCTGTTCCTCGACGAAGTCGCCGACCTGCCGATGGCCATGCAGGTCAAACTGCTCCGGGCGATCCAG
GAAAAGGCCGTGCGCGCGGTCGGCGGCCAGCAGGAGGTCGCCGTCGCACGTGCGCATCCTCTGCGCCACCCACAAGGACC
TCGCCGCCGAAGTCGGCGCCGGGCGCTTCCGCCAGGACCTCTACTACCGCCTCAACGTCATCGAGCTGCGCGTACACCGC
TGCGCGAACGCCGCGAGGACATCCCGCTGCTCGCCGAACGCATCCTCAAGCGCCTGGCCGGCGACACCGGCCTGCCGGCC
GCCAGGCTGACCGGCGACGCACAGGAGAAGCTGAAGAACTACCGCTTCCCGGGCAACGTCCGCGAGCTGGAAAACATGCT
GGAGCGCGCCTATACCCTGTGCGAAGACGACCAGATCCAGCCTCACGACCTGCGCCTGGCCGATGCGCCGGGTGCCAGCC
AGGAAGGCGCCGCGAGCCTGAGCGAAATCGACAACCTCGAGGACTACCTGGAAGACATCGAGCGCAAGCTGATCATGCAG
GCACTCGAGGAGACCCGCTGGAACCGCACCGCCGCGGCCCAGCGCCTGGGCCTGACGTTCCGCTCGATGCGCTACCGCCT
GAAAAAGCTGGGCATCGACTGA

Fig. 3-29

>ORF31266 (SEQ ID NO:350)
AGCTGGACACCCGCAGCGCCCGCAACGTCAAGGAAGCCGCGAGTTGCTGGCCCGCGAGCCGTTCGACCTGTGCCTCACCG
ACATGCGCCTGCCGGACGGCAGCGGCCTCGATCTGGTCCAGTACATCCAGCAGCGCCATCCACAGACCCCGGTGGCCATG
ATCACCGCGTACGGCAGCCTGGACACCGCGATCCAGGCGCTCAAGGCCGGTGCCTTCGACTTCCTCACCAAACCGGTCGA
CCTCGGTCGCTTGCGGGAGCTGGTGGCAACCGCCCTACGCTTGCGCAACCCGGAAGCCGAGGAAGCGCCGGTGGACAACC
GCCTGCTCGGCGAGTCGCCGCCGATGCGCGCCCTGCGCAACCAGATCGGCAAGCTGGCGCGCAGCCAGGCGCCGGTCTAC
ATCAGTGGCGAGTCCGGCAGCGGCAAGGAACTGGTGGCGCGCCTGATCCACGAGCAGGGGCCACGTATCGAGCGGCCGTT
CGTGCCGGTGAACTGCGGCGCGATTCCCTCCGAGCTGATGGAAAGCGAGTTCTTCGGCCACAAGAAAGGCAGCTTCACTG
GCGCTATCGAAGACAAGCAGGGCCTGTTCCAGGCCGCCAGCGGTGGCACCCTGTTCCTCGACGAAGTCGCCGACCTGCCG
ATGGCCATGCAGGTCAAACTGCTCCGGGCGATCCAGGAAAAGGCCGTGCGCGCGGTCGGCGGCCAGCAGGAGGTCGCCGT
CGCACGTGCGCATCCTCTGCGCCACCCACAAGGACCTCGCCGCCGAAGTCGGCGCCGGGCGCTTCCGCCAGGACCTCTAC
TACCGCCTCAACGTCATCGAGCTGCGCGTACACCGCTGCGCGAACGCCGCGAGGACATCCCGCTGCTCGCCGAACGCATC
CTCAAGCGCCTGGCCGGCGACACCGGCCTGCCGGCCGCCAGGCTGACCGGCGACGCACAGGAGAAGCTGAAGAACTACCG
CTTCCCGGGCAACGTCCGCGAGCTGGAAAACATGCTGGAGCGCGCCTATACCCTGTGCGAAGACGACCAGATCCAGCCTC
ACGACCTGCGCCTGGCCGATGCGCCGGGTGCCAGCCAGGAAGGCGCCGCGAGCCTGAGCGAAATCGACAACCTCGAGGAC
TACCTGGAAGACATCGAGCGCAAGCTGATCATGCAGGCACTCGAGGAGACCCGCTGGAACCGCACCGCCGCGGCCCAGCG
CCTGGGCCTGACGTTCCGCTCGATGCGCTACCGCCTGAAAAAGCTGGGCATCGACTGAAAGTGAAAAGGCCTGTCCGAAG
ACAGGCCTTTTGGTTTTCGCTCCTCAGAGGCGACCAGCCGGGGCGTAGGGGCCGGGTCGATGA

>ORF31661c (SEQ ID NO:352)
ACCGGCGCCTGGCTGCGCGCCAGCTTGCCGATCTGGTTGCGCAGGGCGCGCATCGGCGGCGACTCGCCGAGCAGGCGGTT
GTCCACCGGCGCTTCCTCGGCTTCCGGGTTGCGCAAGCGTAGGGCGGTTGCCACCAGCTCCCGCAAGCGACCGAGGTCGA
CCGGTTTGGTGAGGAAGTCGAAGGCACCGGCCTTGAGCGCCTGGATCGCGGTGTCCAGGCTGCCGTACGCGGTGATCATG
GCCACCGGGGTCTGTGGATGGCGCTGCTGGATGTACTGGACCAGATCGAGGCCGCTGCCGTCCGGCAGGCGCATGTCGGT
GAGGCACAGGTCGAACGGCTCGCGGGCCAGCAACTCGCGGCTTCCTTGA

>ORF32061c (SEQ ID NO:354)
AGGTCCTGGCGGAAGCGCCCGGCGCCGACTTCGGCGGCGAGGTCCTTGTGGGTGGCGCAGAGGATGCGCACGTGCGACGG
CGACCTCCTGCTGGCCGCCGACCGCGCGCACGGCCTTTTCCTGGATCGCCCGGAGCAGTTTGACCTGCATGGCCATCGGC
AGGTCGGCGACTTCGTCGAGGAACAGGGTGCCACCGCTGGCGGCCTGGAACAGGCCCTGCTTGTCTTCGATAGCGCCAGT
GAAGCTGCCTTTCTTGTGGCCGAAGAACTCGCTTTCCATCAGCTCGGAGGGAATCGCGCCGCAGTTCACCGGCACGAACG
GCCGCTCGATACGTGGCCCCTGCTCGTGGATCAGGCGCGCCACCAGTTCCTTGCCGCTGCCGGACTCGCCACTGATGTAG
ACCGGCGCCTGGCTGCGCGCCAGCTTGCCGATCTGGTTGCGCAGGGCGCGCATCGGCGGCGACTCGCCGAGCAGGCGGTT
GTCCACCGGCGCTTCCTCGGCTTCCGGGTTGCGCAAGCGTAG

>ORF32072c (SEQ ID NO:356)
GGCGGTAGTAGAGGTCCTGGCGGAAGCGCCCGGCGCCGACTTCGGCGGCGAGGTCCTTGTGGGTGGCGCAGAGGATGCGC
ACGTGCGACGGCGACCTCCTGCTGGCCGCCGACCGCGCGCACGGCCTTTTCCTGGATCGCCCGGAGCAGTTTGACCTGCA
TGGCCATCGGCAGGTCGGCGACTTCGTCGAGGAACAGGGTGCCACCGCTGGCGGCCTGGAACAGGCCCTGCTTGTCTTCG
ATAGCGCCAGTGAAGCTGCCTTTCTTGTGGCCGAAGAACTCGCTTTCCATCAGCTCGGAGGGAATCGCGCCGCAGTTCAC
CGGCACGAACGGCCGCTCGATACGTGGCCCCTGCTCGTGGATCAGGCGCGCCACCAGTTCCTTGCCGCTGCCGGACTCGC
CACTGATGTAG

>ORF31784 (SEQ ID NO:358)
TGGAAAGCGAGTTCTTCGGCCACAAGAAAGGCAGCTTCACTGGCGCTATCGAAGACAAGCAGGGCCTGTTCCAGGCCGCC
AGCGGTGGCACCCTGTTCCTCGACGAAGTCGCCGACCTGCCGATGGCCATGCAGGTCAAACTGCTCCGGGCGATCCAGGA
AAAGGCCGTGCGCGCGGTCGGCGGCCAGCAGGAGGTCGCCGTCGCACGTGCGCATCCTCTGCGCCACCCACAAGGACCTC
GCCGCCGAAGTCGGCGCCGGGCGCTTCCGCCAGGACCTCTACTACCGCCTCAACGTCATCGAGCTGCGCGTACACCGCTG
CGCGAACGCCGCGAGGACATCCCGCTGCTCGCCGAACGCATCCTCAAGCGCCTGGCCGGCGACACCGGCCTGCCGGCCGC
CAGGCTGA

Fig. 3-30

>ORF32568c (SEQ ID NO:360)
GGAGCGAAAACCAAAAGGCCTGTCTTCGGACAGGCCTTTTCACTTTCAGTCGATGCCCAGCTTTTTCAGGCGGTAGCGCA
TCGAGCGGAACGTCAGGCCCAGGCGCTGGGCCGCGGCGGTGCGGTTCCAGCGGGTCTCCTCGAGTGCCTGCATGATCAGC
TTGCGCTCGATGTCTTCCAGGTAGTCCTCGAGGTTGTCGATTTCGCTCAGGCTCGCGGCGCCTTCCTGGCTGGCACCCGG
CGCATCGGCCAGGCGCAGGTCGTGAGGCTGGATCTGGTCGTCTTCGCACAGGGTATAGGCGCGCTCCAGCATGTTTTCCA
GCTCGCGGACGTTGCCCGGGAAGCGGTAGTTCTTCAGCTTCTCCTGTGCGTCGCCGGTCAGCCTGGCGGCCGGCAGGCCG
GTGTCGCCGGCCAGGCGCTTGAGGATGCGTTCGGCGAGCAGCGGGATGTCCTCGCGGCGTTCGCGCAGCGGTGTACGCGC
AGCTCGATGACGTTGAGGCGGTAG

>ORF33157c (SEQ ID NO:362)
ACAGACGGAGGTGCGCGGCTGGTTGCGCGACGGCGATCGAGTGGTCGGCGTGGCGACCTCGCGTGGCGAGATCCGTGGCG
ACAAGGTGCTGCTGGCGGCAGGCGCCTGGAGCGGCGAGTTGTTGAAGCCGCTTGGCCTGGAACTGCCCGTGGTACCGGTG
AAAGGTCAGATGATCCTCTACAAGTGCGCGGCGGATTTCCTGCCGCGCATGGTGCTGGCCAAGGGGCGCTACGCGATTCC
GCGGCGCGACGGCCACATCCTGATCGGCAGCACCTTGGAACATTCGGGCTTCGACAAGACGCCGACCGACGAGGCGCTGG
AAAGCCTCAGGGCGTCTGCGGCAGAACTGTTGCCGGAACTGGCGGACATGCAGCCGGTGGCCCACTGGGCAGGGTTGCGC
CCGGGCTCTCCCGAAGGCATCCCCTATATCGGTCCGGTGCCTGGCTTCGACGGGCTCTGGCTGAATACCGGGCACTACCG
CAACGGGCTGGTCCTGGCACCGGCGTCGTGCCGTCTGCTGGCGGATCTCATGAGCGGGCGGGAACCGATCATCGACCCGG
CCCCCTACGCCCCGGCTGGTCGCCTCTGAGGAGCGAAAACCAAAAGGCCTGTCTTCGGACAGGCCTTTTCACTTTCAGTC
GATGCCCAGCTTTTTCAGGCGGTAGCGCATCGAGCGGAACGTCAGGCCCAGGCGCTGGGCCGCGGCGGTGCGGTTCCAGC
GGGTCTCCTCGAGTGCCTGCATGA

>ORF32530 (SEQ ID NO:364)
AAAGGCCTGTCCGAAGACAGGCCTTTTGGTTTTCGCTCCTCAGAGGCGACCAGCCGGGGCGTAGGGGGCCGGGTCGATGA
TCGGTTCCCGCCCGCTCATGAGATCCGCCAGCAGACGGCACGACGCCGGTGCCAGGACCAGCCCGTTGCGGTAGTGCCCG
GTATTCAGCCAGAGCCCGTCGAAGCCAGGCACCGGACCGATATAGGGGATGCCTTCGGGAGAGCCCGGGCGCAACCCTGC
CCAGTGGGCCACCGGCTGCATGTCCGCCAGTTCCGGCAACAGTTCTGCCGCAGACGCCCTGAGGCTTTCCAGCGCCTCGT
CGGTCGGCGTCTTGTCGAAGCCCGAATGTTCCAAGGTGCTGCCGATCAGGATGTGGCCGTCGCGCCGCGGAATCGCGTAG
CGCCCCTTGGCCAGCACCATGCGCGGCAGGAAATCCGCCGCGCACTTGTAGAGGATCATCTGACCTTTCACCGGTACCAC
GGGCAGTTCCAGGCCAAGCGGCTTCAACAACTCGCCGCTCCAGGCGCCTGCCGCCAGCAGCACCTTGTCGCCACGGATCT
CGCCACGCGAGGTCGCCACGCCGACCACTCGATCGCCGTCGCGCAACCAGCCGCGCACCTCCGTCTGTTCATGCAACTCG
AGATTGGCGAATTGTTGCAGGGATGCCCGCAATGA

>ORF33705c (SEQ ID NO:366)
GTGATATTTCTCTGTTCCTGGCAAATCGGTAGGAGCCCTGTGGTGAGTAGAGATGTAGTAGTGGTAGGCGCTGGCGTCAT
CGGCCTGTTGACCGCCCGGGAGCTGGCGCTCGCCGGACTGCGGGTGACCCTGGTGGAGCGGGGCGAGAGTGGGCGTGAGG
CATCCTGGGCGGGAGGCGGGATCGTCTCGCCGCTCTATCCGTGGCGCTACAGCCCGGCGGTGACCGCCCTGGCGCACTGG
TCGCAGGACTTCTACCCGGCCCTGGGGCAGCGTTTGCTCGACGAGACCGGGCTCGATCCCGAGGTCCATACCGTTGGCCT
GTACTGGCTGGACCTGGACGACCAGACCGAGGCACTGCAGTGGGCACGCAACCACACCCGGCCGTTGAAGGAAGTGCCGA
TCGAGGAGGCCTACGCGGCGGTGCCCGGGCTGGGCGCAGGCTTCCAGCGGGCGGTCTACATGTCGGGCGTGGCCAATGTG
CGCAATCCTCGCCTGGCGCGCTCATTGCGGGCATCCCTGCAACAATTCGCCAATCTCGAGTTGCATGAACAGACGGAGGT
GCGCGGCTGGTTGCGCGACGGCGATCGAGTGGTCGGCGTGGCGACCTCGCGTGGCGAGATCCGTGGCGACAAGGTGCTGC
TGGCGGCAGGCGCCTGGAGCGGCGAGTTGTTGAAGCCGCTTGGCCTGGAACTGCCCGTGGTACCGGTGAAAGGTCAGATG
ATCCTCTACAAGTGCGCGGCGGATTTCCTGCCGCGCATGGTGCTGGCCAAGGGGCGCTACGCGATTCCGCGGCGCGACGG
CCACATCCTGATCGGCAGCACCTTGGAACATTCGGGCTTCGACAAGACGCCGACCGACGAGGCGCTGGAAAGCCTCAGGG
CGTCTGCGGCAGAACTGTTGCCGGAACTGGCGGACATGCAGCCGGTGGCCCACTGGGCAGGGTTGCGCCCGGGCTCTCCC
GAAGGCATCCCCTATATCGGTCCGGTGCCTGGCTTCGACGGGCTCTGGCTGAATACCGGGCACTACCGCAACGGGCTGGT
CCTGGCACCGGCGTCGTGCCGTCTGCTGGCGGATCTCATGAGCGGGCGGGAACCGATCATCGACCCGGCCCCCTACGCCC
CGGCTGGTCGCCTCTGA

Fig. 3-31

>ORF32832 (SEQ ID NO:368)
GGCTTTCCAGCGCCTCGTCGGTCGGCGTCTTGTCGAAGCCCGAATGTTCCAAGGTGCTGCCGATCAGGATGTGGCCGTCG
CGCCGCGGAATCGCGTAGCGCCCCTTGGCCAGCACCATGCGCGGCAGGAAATCCGCCGCGCACTTGTAGAGGATCATCTG
ACCTTTCACCGGTACCACGGGCAGTTCCAGGCCAAGCGGCTTCAACAACTCGCCGCTCCAGGCGCCTGCCGCCAGCAGCA
CCTTGTCGCCACGGATCTCGCCACGCGAGGTCGCCACGCCGACCACTCGATCGCCGTCGCGCAACCAGCCGCGCACCTCC
GTCTGTTCATGCAACTCGAGATTGGCGAATTGTTGCAGGGATGCCCGCAATGAGCGCGCCAGGCGAGGATTGCGCACATT
GGCCACGCCCGACATGTAGACCGCCCGCTGGAAGCCTGCGCCCAGCCCGGGCACCGCCGCGTAGGCCTCCTCGATCGGCA
CTTCCTTCAACGGCCGGGTGTGGTTGCGTGCCCACTGCAGTGCCTCGGTCTGGTCGTCCAGGTCCAGCCAGTACAGGCCA
ACGGTATGGACCTCGGGATCGAGCCCGGTCTCGTCGAGCAAACGCTGCCCCAGGGCCGGGTAGAAGTCCTGCGACCAGTG
CGCCAGGGCGGTCACCGCCGGGCTGTAGCGCCACGGATAGAGCGGCGAGACGATCCCGCCTCCCGCCCAGGATGCCTCAC
GCCCACTCTCGCCCCGCTCCACCAGGGTCACCCGCAGTCCGGCGAGCGCCAGCTCCCGGGCGGTCAACAGGCCGATGA

>ORF33547c (SEQ ID NO:370)
GGCATCCTGGGCGGGAGGCGGGATCGTCTCGCCGCTCTATCCGTGGCGCTACAGCCCGGCGGTGACCGCCCTGGCGCACT
GGTCGCAGGACTTCTACCCGGCCCTGGGGCAGCGTTTGCTCGACGAGACCGGGCTCGATCCCGAGGTCCATACCGTTGGC
CTGTACTGGCTGGACCTGGACGACCAGACCGAGGCACTGCAGTGGGCACGCAACCACACCCGGCCGTTGAAGGAAGTGCC
GATCGAGGAGGCCTACGCGGCGGTGCCCGGGCTGGGCGCAGGCTTCCAGCGGGCGGTCTACATGTCGGGCGTGGCCAATG
TGCGCAATCCTCGCCTGGCGCGCTCATTGCGGGCATCCCTGCAACAATTCGCCAATCTCGAGTTGCATGA

>ORF33205 (SEQ ID NO:372)
GCGCGCCAGGCGAGGATTGCGCACATTGGCCACGCCCGACATGTAGACCGCCCGCTGGAAGCCTGCGCCCAGCCCGGGCA
CCGCCGCGTAGGCCTCCTCGATCGGCACTTCCTTCAACGGCCGGGTGTGGTTGCGTGCCCACTGCAGTGCCTCGGTCTGG
TCGTCCAGGTCCAGCCAGTACAGGCCAACGGTATGGACCTCGGGATCGAGCCCGGTCTCGTCGAGCAAACGCTGCCCCAG
GGCCGGGTAGAAGTCCTGCGACCAGTGCGCCAGGGCGGTCACCGCCGGGCTGTAGCGCCACGGATAGAGCGGCGAGACGA
TCCCGCCTCCCGCCCAGGATGCCTCACGCCCACTCTCGCCCCGCTCCACCAGGGTCACCCGCAGTCCGGCGAGCGCCAGC
TCCCGGGCGGTCAACAGGCCGATGACGCCAGCGCCTACCACTACTACATCTCTACTCACCACAGGGCTCCTACCGATTTG
CCAGGAACAGAGAAATATCACTCAAAGGGATCAGATGCTGACGAATTGCCTGCTTCAACGAACTCAGTCGAATCTAGTCC
CGGTGAAAAGCCCATCATACCCGCAGAGGTATTCATCCCATGA

>ORF33512 (SEQ ID NO:374)
AGCGGCGAGACGATCCCGCCTCCCGCCCAGGATGCCTCACGCCCACTCTCGCCCCGCTCCACCAGGGTCACCCGCAGTCC
GGCGAGCGCCAGCTCCCGGGCGGTCAACAGGCCGATGACGCCAGCGCCTACCACTACTACATCTCTACTCACCACAGGGC
TCCTACCGATTTGCCAGGAACAGAGAAATATCACTCAAAGGGATCAGATGCTGACGAATTGCCTGCTTCAACGAACTCAG
TCGAATCTAGTCCCGGTGAAAAGCCCATCATACCCGCAGAGGTATTCATCCCATGAAATCGAGTGGTTTGAATTTGGTGG
AACTATCGATAGTCCTATCGATCCTTGCGATAGGCGTGACAATTGCGCTGCCCACCCTCCCCGACAGAATGAAGCGGGAC
ATTAG

>ORF33771 (SEQ ID NO:376)
AAAGCCCATCATACCCGCAGAGGTATTCATCCCATGAAATCGAGTGGTTTGAATTTGGTGGAACTATCGATAGTCCTATC
GATCCTTGCGATAGGCGTGACAATTGCGCTGCCCACCCTCCCCGACAGAATGAAGCGGGACATTAGCCGTGATATTGGTG
ACAGCCTGACTAGTCATGTGATGGCTGCGCGGGCTAGCAGCATACAGAACGGCGTGATCATCGAGGTGTGCGGTAGCGGT
GACGGCAGTACCTGCAGCGAGGAATGGCATCTCGGCTGGTTCAGCCGTAACGACAGGAGCCAACAGATACTGGCCCGGCA
TGAAAATACGAGTCGCACCGATATTCATTGGCGGGCTTCGACAAGCGACTGCGCTACCTGCCTAATGGCACCAGCCCTA
CAGGTAACGGGCGTTTCTTCGAATGTAAGGACGATCGCATCGAGTGGCAATTGGTGCTCAATCGGCAAGGCCGCCTCAGG
GTGGCGGGAAAGAGCGAAAATAAAAAGCTCTCTTACCTGTGCTCCAGGCGGTGA

>ORF34385c (SEQ ID NO:378)
TGGAGAGCGCATTGTCCCTGTAGCAGAGACAGCCGGAGCGGAGAGTGGGATGACTGGCAAACGGTATGTGAAACAGTTCT
CTCACCGCCTGGAGCACAGGTAAGAGAGCTTTTTATTTTCGCTCTTTCCCGCCACCCTGAGGCGGCCTTGCCGATTGAGC
ACCAATTGCCACTCGATGCGATCGTCCTTACATTCGAAGAAACGCCCGTTACCTGTAGGGCTGGTGCCATTAGGCAGGTA
GCGCAGTCGCTTGTCGAAGCCCCGCCAATGAATATCGGTGCGACTCGTATTTTCATGCCGGGCCAGTATCTGTTGGCTCC
TGTCGTTACGGCTGAACCAGCCGAGATGCCATTCCTCGCTGCAGGTACTGCCGTCACCGCTACCGCACACCTCGATGATC
ACGCCGTTCTGTATGCTGCTAGCCCGCGCAGCCATCACATGACTAGTCAGGCTGTCACCAATATCACGGCTAATGTCCCG
CTTCATTCTGTCGGGGAGGGTGGGCAGCGCAATTGTCACGCCTATCGCAAGGATCGATAG

Fig. 3-32

>ORF33988 (SEQ ID NO:380)
TCATCGAGGTGTGCGGTAGCGGTGACGGCAGTACCTGCAGCGAGGAATGGCATCTCGGCTGGTTCAGCCGTAACGACAGG
AGCCAACAGATACTGGCCCGGCATGAAAATACGAGTCGCACCGATATTCATTGGCGGGGCTTCGACAAGCGACTGCGCTA
CCTGCCTAATGGCACCAGCCCTACAGGTAACGGGCGTTTCTTCGAATGTAAGGACGATCGCATCGAGTGGCAATTGGTGC
TCAATCGGCAAGGCCGCCTCAGGGTGGCGGGAAAGAGCGAAAATAAAAAGCTCTCTTACCTGTGCTCCAGGCGGTGAGAG
AACTGTTTCACATACCGTTTGCCAGTCATCCCACTCTCCGCTCCGGCTGTCTCTGCTACAGGGACAATGCGCTCTCCACT
AG

>ORF34274 (SEQ ID NO:382)
AAAGCTCTCTTACCTGTGCTCCAGGCGGTGAGAGAACTGTTTCACATACCGTTTGCCAGTCATCCCACTCTCCGCTCCGG
CTGTCTCTGCTACAGGGACAATGCGCTCTCCACTAGGCAAGATTATCTGGCCCTTTTCCTTGTGGAGTACTGCATGCGCT
CTATTTGTCGCAGCGCCGGCTTTTCCCTGATCGAGTTGATGATGGTGTTGGTTCTGGTCGCCATATTCGCCAGCATTGCC
GTACCCAGTTTCAACGCCTTGATCGAGCGCAACCGAATCCAGACTGCCAGCGAGGAACTCTACAGCCTGCTTCAGTACGC
TCGCAGCGAAGCTGTAAACCGTCATGCCAATGTGAGCATCAGGGCGACGCAGAACAATGACTGGGCAAAAGGCCTGGAAA
TCATCAGCGGCGCGACCACCGTGCAAAAGCACCAAGGTTTCCAGCAGGTCTCGCTATCCGCCAGCAGTGCGACTGCGGAG
CTGACCTTCAACGCTACCGGCACACTTAGCAACCAGGCTGCAAACATTGACATAAAGGTCTGCTTCGCCGGTGACAAAAG
TACAGGACGTCTGCTTACCGTTCAGCCCAGTGGACGCGTGATCCTGTACCCATCTTCAAAGCAACCGGACAGCTGTAACT
GA

>ORF34726c (SEQ ID NO:384)
CGAGACCTGCTGGAAACCTTGGTGCTTTTGCACGGTGGTCGCGCCGCTGATGATTTCCAGGCCTTTTGCCCAGTCATTGT
TCTGCGTCGCCCTGATGCTCACATTGGCATGACGGTTTACAGCTTCGCTGCGAGCGTACTGAAGCAGGCTGTAGAGTTCC
TCGCTGGCAGTCTGGATTCGGTTGCGCTCGATCAAGGCGTTGAAACTGGGTACGGCAATGCTGGCGAATATGGCGACCAG
AACCAACACCATCATCAACTCGATCAGGGAAAAGCCGGCGCTGCGACAAATAGAGCGCATGCAGTACTCCACAAGGAAAA
GGGCCAGATAATCTTGCCTAGTGGAGAGCGCATTGTCCCTGTAGCAGAGACAGCCGGAGCGGAGAGTGGGATGACTGGCA
AACGGTATGTGAAACAGTTCTCTCACCGCCTGGAGCACAGGTAA

>ORF34916 (SEQ ID NO:386)
GGAAAGCCCATGTCTCGAGAAACGGGTTTCAGCATGATCGAAGTACTGGTTGCTCTGGTGCTGATCAGCATTGGCGTACT
GGGCATGGTTGCCATGCAAGGGCGCACGATCCAGTACACGCAGGAGTCGGTACAACGCAATGCCGCAGCAATGCTTGCTA
GCGACCTGATGGAAATAATGCGTGCGGACCCAGATGCCGTACTCAATCTACGCGCCCAACTACGCGAAGACTCGGTCTAC
TACAAGGCCAAGGGCAGCGACTTTCCCGCAGCCCAGCGCGCTGCGCGCCATTGCCAGCAGATGCTAAGGAACGTCTCGG
CTGCTGGGCCCAACAGGCCTCGAAAGACTTGCCGGGAGCCTCCGCACTCTTGAATAGCCAATTCTACATTTGTCGCAGCC
CAACCCCGGGTACCTGCGACAACACCAAAGGCTCGGCCATCGAAATCCAGGTTGCCTGGCGAGCCATGGATGGAGCGTGT
TTCAACGCCTCTGACTCCACCTTGTGCACCTACAGCGTCCGCTCCGAATTGTGA

>ORF35464c (SEQ ID NO:388)
AGAGCATGCTTGTTCTCACAATTCGGAGCGGACGCTGTAGGTGCACAAGGTGGAGTCAGAGGCGTTGAAACACGCTCCAT
CCATGGCTCGCCAGGCAACCTGGATTTCGATGGCCGAGCCTTTGGTGTTGTCGCAGGTACCCGGGGTTGGGCTGCGACAA
ATGTAGAATTGGCTATTCAAGAGTGCGGAGGCTCCCGGCAAGTCTTTCGAGGCCTGTTGGGCCCAGCAGCCGAGACGTTC
CTTAGCATCTGCTGGCAATGGCGCGCAGCGCGCTGGGGCTGCGGGAAAGTCGCTGCCCTTGGCCTTGTAGTAGACCGAGT
CTTCGCGTAG

>ORF35289 (SEQ ID NO:390)
ATAGCCAATTCTACATTTGTCGCAGCCCAACCCCGGGTACCTGCGACAACACCAAAGGCTCGGCCATCGAAATCCAGGTT
GCCTGGCGAGCCATGGATGGAGCGTGTTTCAACGCCTCTGACTCCACCTTGTGCACCTACAGCGTCCGCTCCGAATTGTG
AGAACAAGCATGCTCTTCAGCAAAATGCAGAAAGGCCTATCGATGGTAGAACTGCTCGTGGCACTCGCTATAAGCAGCTT
CCTGATCCTGGGGATCAGCCAGATCTACATCGACAACAAACGCAACTATCTTTTCCAGCAAGGCCAGGCCGGCAACCAGG
AAAATAG

Fig. 3-33

>ORF35410 (SEQ ID NO:392)
CTCCACCTTGTGCACCTACAGCGTCCGCTCCGAATTGTGAGAACAAGCATGCTCTTCAGCAAAATGCAGAAAGGCCTATC
GATGGTAGAACTGCTCGTGGCACTCGCTATAAGCAGCTTCCTGATCCTGGGGATCAGCCAGATCTACATCGACAACAAAC
GCAACTATCTTTTCCAGCAAGGCCAGGCCGGCAACCAGGAAAATAGCCGCTTCGTTCTTATGCTGCTGCAGCAACAACTG
GATAAGACAGCCTATCGTCGCCTTCACGACGACAACATGGAGAATGCTTTCAAATCCGCGACATTCAATGGCTGTCGTGC
ATTTGTGGCTGGCGAGACTATCGCTGCGGCAACTGCCCTCAAGGCGGGTGAGTACGGTGTCTGCTTGCGCTATCAACCCG
CCTACAAAGGGGAGCATGATTGCCTCGGTAATGAAATTACCGGAGTTCCGGAAAAGCCCTTCACAAATACTCCCCCTGTC
GTCGTTCGCCTGGTCTACCTACCGAGCGCCGGTACCCTGAGTTGCAGTCGTCCCGATATCGCCCAGTCGAAATCGGGAGA
ATTGGTCAGTGGTCTCACAGACTTCCGCTTGGAAGCGGGGGTCGGGCCAGCAGATCGTAGCGAACGCAAAGTATCCAGCT
TCGTCGCACTACAGGATGTCGCCGGTCGTCCTATCCGAGCATTGCGCTTCTCAATCCTGGCAGGCAGCGACAATACAAGC
CTGCGCACAGGAGATGATAGCCAGGCACGCGATCGCTGGATCGTCCTTTATCCCGAGAGCAAAAGCGCCATCGAGGCCGC
AGACAAAGGCCAGATTTACCAAATAGCGCGTGGTAACCAAACCATCAGGAATCTCATGCCATGA

>ORF35907c (SEQ ID NO:394)
GTAGACCAGGCGAACGACGACAGGGGGAGTATTTGTGAAGGGCTTTTCCGGAACTCCGGTAATTTCATTACCGAGGCAAT
CATGCTCCCCTTTGTAGGCGGGTTGATAGCGCAAGCAGACACCGTACTCACCCGCCTTGAGGGCAGTTGCCGCAGCGATA
GTCTCGCCAGCCACAAATGCACGACAGCCATTGAATGTCGCGGATTTGAAAGCATTCTCCATGTTGTCGTCGTGAAGGCG
ACGATAGGCTGTCTTATCCAGTTGTTGCTGCAGCAGCATAAGAACGAAGCGGCTATTTTCCTGGTTGCCGGCCTGGCCTT
GCTGGAAAAGATAGTTGCGTTTGTTGTCGATGTAGATCTGGCTGATCCCCAGGATCAGGAAGCTGCTTATAGCGAGTGCC
ACGAGCAGTTCTACCATCGATAG

>ORF35534 (SEQ ID NO:396)
TCCTGGGGATCAGCCAGATCTACATCGACAACAAACGCAACTATCTTTTCCAGCAAGGCCAGGCCGGCAACCAGGAAAAT
AGCCGCTTCGTTCTTATGCTGCTGCAGCAACAACTGGATAAGACAGCCTATCGTCGCCTTCACGACGACAACATGGAGAA
TGCTTTCAAATCCGCGACATTCAATGGCTGTCGTGCATTTGTGGCTGGCGAGACTATCGCTGCGGCAACTGCCCTCAAGG
CGGGTGAGTACGGTGTCTGCTTGCGCTATCAACCCGCCTACAAAGGGGAGCATGATTGCCTCGGTAATGAAATTACCGGA
GTTCCGGAAAAGCCCTTCACAAATACTCCCCCTGTCGTCGTTCGCCTGGTCTACCTACCGAGCGCCGGTACCCTGA

>ORF35930 (SEQ ID NO:398)
GTTGCAGTCGTCCCGATATCGCCCAGTCGAAATCGGGAGAATTGGTCAGTGGTCTCACAGACTTCCGCTTGGAAGCGGGG
GTCGGGCCAGCAGATCGTAGCGAACGCAAAGTATCCAGCTTCGTCGCACTACAGGATGTCGCCGGTCGTCCTATCCGAGC
ATTGCGCTTCTCAATCCTGGCAGGCAGCGACAATACAAGCCTGCGCACAGGAGATGATAGCCAGGCACGCGATCGCTGGA
TCGTCCTTTATCCCGAGAGCAAAAGCGCCATCGAGGCCGCAGACAAAGGCCAGATTTACCAAATAG

>ORF36246 (SEQ ID NO:400)
CCAAACCATCAGGAATCTCATGCCATGACCCTGCGCCATACCTCTCGACAGCAGGGATCCACGTTGTTGATCTCGCTGGT
TATCTTGTTGATGATCACGCTCCTCGCCGTTTCCAACATGCGCGAGGTGTCACTGGAAAGCCGTATCACCGGCAATCTCA
TCGAACAGAAGCGCCTGCGCAATGCGGGCGAAGCTGGGCTACGCGAAGGTGAACGACGCTTTTTCAATACCATCAAGCCC
CCAGAGGTCGGCAGCGGATGCGCCGATAGCAATGTCAAACGGCCTTGCATACTGAACCTGAGTGCCCTCTCCGTACCCCG
AGATGACGTGCACAACAATCCGGTGGCAGCCCTGAACGGCAAGACAGATAACGCCAATTCACGTGTCTGGATGCCCTACC
GAGGCAGCGATCTGAATAACCCTACGCAGATCGACAAAGACCGCGCAGTCACCTGGCAGACCATCACGGTGCCCGCTGGC
GAACAGAACAACGAAGCGGAAAATCCCGAGTACGGCAACATGATGCGCGGGGTCGGCACGTTCTACTACGAAACCAACAG
CCGCGCCCTCAACAAGGCGGGCGGAGAGACTGTTCTACAGGCCGTTCATGCACGCCTGTATACCAACTGA

>ORF26640c (SEQ ID NO:402)
GGCATCCAGACACGTGAATTGGCGTTATCTGTCTTGCCGTTCAGGGCTGCCACCGGATTGTTGTGCACGTCATCTCGGGG
TACGGAGAGGGCACTCAGGTTCAGTATGCAAGGCCGTTTGACATTGCTATCGGCGCATCCGCTGCCGACCTCTGGGGGCT
TGATGGTATTGAAAAAGCGTCGTTCACCTTCGCGTAGCCCAGCTTCGCCCGCATTGCGCAGGCGCTTCTGTTCGATGAGA
TTGCCGGTGATACGGCTTTCCAGTGACACCTCGCGCATGTTGGAAACGGCGAGGAGCGTGATCATCAACAAGATAACCAG
CGAGATCAACAACGTGGATCCCTGCTGTCGAGAGGTATGGCGCAGGGTCATGGCATGA

Fig. 3-34

\>ORF36769 (SEQ ID NO:404)
TGCGCGGGGTCGGCACGTTCTACTACGAAACCAACAGCCGCGCCCTCAACAAGGCGGGCGGAGAGACTGTTCTACAGGCC
GTTCATGCACGCCTGTATACCAACTGACTGGAGCCAGCGCATGATCCACCAGATTACCCGCGCAGGAAAAAGCCTGCTGG
CTGCAGGTTGCACCCTGAGCATCCTGTTCGCCTCTGACAGTTATGCCGCCACGGCCCTGAATGTCAGCCAGCAACCCCTG
TTCCTAACCCAGGGCGTTGCTCCCAACCTGCTGTTCACTCTAGATGACTCAGGCAGTATGGCCTGGGCTTACGTGCCCGA
CGGTATTAGCGGGAATAGCGGCAGAGCGGGACGTTCCAGCGATTACAACGCACTGTACTACAACCCCGATTATGCTTACC
AAGTGCCCAAGAAATTGACACTGTCAGGCGATCAGATCATCGTTTCCGACTATCCAGTGCCACGCTTCACAGCAGCCTGG
CAGGATGGCTACGCCCAAGGCTCCACCACCAACCTGAGCAATAACTATCGCCCTCAATGGGGAACCGGCTGGCTTGGTTG
CATCGATAGCAGCTGCAATACCGGGAGAGCTTATTACTATACTTATAAGGTAAGCGCTAGCTGCCCTGCACAGCCGGTGA
GCAGCTCCAACTCCTGTTATACCTACAATGCTCTTCCTACCAGTCAGGAAAGCAACTTTGCGATATGGTACTCCTACTAT
CGCAACCGCATCCTGGCCACAAAGACCGCTGCCAACCTGGCCTTTTACAGCCTGCCGGAAAACGTGCGTCTCACTTGGGG
GGCCCTGAACACCTGTAGCATCGGCGCCAACAGCAGAAGCTGCCAAAACAATGCCCTGCTCCAATTCAACAAGCAGCACA
AAATCAATTTCTTCAATTGGCTGGCGAACAGCCCGGCCAGCGGCGGTACTCCTCTGCATGCGGCTCTTGACCGAGCCGGA
CGCTTCTTGCAAACCAACGGCACAGCTTATACCACCGAAGACGGAAAGACATATTCCTGCCGGGCCAGCTATCACATCAT
GATGACCGACGGTATCTGGAACGGTCGGAACGTCACCCCCGGCAATCTCGACAACCAGAACCAGACCTTTCCTGATAGCA
CCCTCTATAGGCCACAGCCCCCTTATGCCGACAGCAATGCCAGCTCATTGGCTGACCTGGCTTTCAAATACTGGACCACA
GACTTACGTCCCAGCATCGACAATGACCTGAAGCCTTTCATGGCCTACAAGAGTGGGGACGATTCCAAGGATTACTGGGA
CCCTCGCAACAACCCAGCCACTTGGCAACACATGGTCAACTTTACCGTTGGCCTAGGTCTTTCCTATTCGCTCACATTGA
ACTCTGCACCAACTTGGACAGGCAGCACCTTTGGCAACTACGAGGAGTTGATGGCTGGAAGCAAGGCTTGGCCCAGCGTC
GATAACGACGCCGCACCCGGTAACGTCTACGACCTCTGGCATGCAGCTATCAACTCTCGTGGAGACTTCTTTAGCGCGGA
ATCACCGGACTCTCTGGTTCAGGCTTTCAATAAGATCCTGACACGGATTTCCGAGCGCAACACCTCCTCCTCCAAACCAG
CAATGACTTCCGCGCTGCAGGATGACGGAACCGGCGACAAGCTGATCCGCTACAGCTACCAGTCCAGCTTTGCCAGTGAC
AAGAACTGGGCGGCGACCTTATACGTTACAAGGTGGAGTCGACTTCCACCGGTTCGACCAAAACCCAGGAATGGAGCGC
CGGCGCACTGCTGGACAACCGAGCTCCCGCTACCCGTAATATTTACATCGCCAGCAATAGCGGAACCAACCGCCTTAAGC
CTTTCACATGGAGCAATATTGAGGGAAGTCAGTTAGCCACTTGGCTGAACCGCAACCCGGACAAGGACAATCAGGCCGAC
ACCAAAGGAGCACAGCGGGTCGACTTCATCCGTGGCCAGCAGAATATGGATGGATTCCGGCAACGACAGGCGGTGTTAGG
GGACATCGTGCACTCGTCTCCAGCCGTGGTCGGACCGGCCCAATACCTCACTTATCTGGCCAACCCCATCGAACCCAGCG
GCGACTACGGCACATTCAAGACAGAGGCAGACCAGCGCAGCCCTAGAGTTTATGTTGGATCCAACGATGGCATGTTGCAT
GGTTTCAACATCAAAACCGGCGTGGAAGAGTTCGCTTTCATCCCTACAGCAGTATTCGAAAAGCTTAACAAGCTTACCGG
CATCAGCTACCAGGGCGGTGCCCACCAATATTTCGTCGACGCTACACCGGTCGTCAGCGATGCCTTTTTCGATGGAGCTT
GGCACACTGTTCTGATCGGAACGCTTGGTGCTGGAGGTCGCGGCCTGTTCGCACTCGATGTAACCAAGCCGGACGATGTC
AAGCTGCTTTGGGAATACGATAGCAGTACCGACTCGGACCTTGGTTACACCTTCTCCAAACCTACCGTAGCCAGACTGCA
CAGCGGACAATGGGCAGTAGTTACCGGCAACGGCTATGGAAGCGATAATGACAAGGCAGCTTTACTGCTGATTGATTTGA
AAAAGGGAACGCTGATCAAGAAGCTGGAAGTCCAAAGCGAGCGCGGAATAGCCAATGGCCTATCGACGCCTCGCCTGGCT
GATAACAACAGCGATGGCATTGCTGACTACGCCTATGCTGGCGATCTGCAGGGAAATATCTGGCGCTTCGATTTGATCGG
CAATACCCGCAACGACGACCCAGACACAAATACCTCTATCAATCCCTTCAAGCCCGGAGATGTAGATCCTTCTGCTTTCA
GAGTATCGTTCAGCGGCGCCCCGCTTTTCCGTGCTCGCGCCGACAACAATACTCGTCAGCCCATCACGGCTCCGCCTACC
TTGGTACGCCATCCTAGCCGTAAGGGCTACATCGTCATCGTAGGTACAGGAAAATACTTCGAGGACGATGACGCTCAGGC
CGATACCAGCCGAGCCATGACGCTCTATGGTATCTGGGATCGCCAGACCAAGGGCGAAAGCGCAAACAGTACCCCAACCA
TCGACCGCAACGCCCTCACAGCCCAAACCATGACAACAGAGGCGAACTCCACATTCGGTAGCGTGAACAGGAATATTCGG
CTTATTAGCCAAAACCCGGTGAAGTGGTACAAAGACGGAGCAACCGGTACCGCGAACTCGGATGTGGCTAGCTATGGCTG
GCGACTGAATCTGGAGGTCAATAGCAGCAAGAAAGGCGAAATGATGATCGAAGATATGTTCGCTGCCGGCCAAGTGCTTC
TATTGCAGACCTTGACACCGAACGACGACCCTTGTGACAGCGGCTCTACCAGCTGGACCTACGGCCTCAATCCATATACT
GGCGGACGTACCAGTTTCACCGTCTTCGATCTCAAACGTGCGGGTATAGTGGACTCTGGCTCGGATTACAACGGCTCGGT
CGTATCCGCCTTCCAACAGGATGGACTAGGTGGCTTGGCCATTACCCAGAACGAACAGCGTCAATCCGAGGCTTGCACTG
GTGATGAGTGCATCATCTTCAACCCCAGCGACAAGAGTAACGGACGACAAACCTGGCGGGTCGTCGAGGAGAAATGA

Fig. 3-35

>ORF37932c (SEQ ID NO:406)
GCTGGCATTGCTGTCGGCATAAGGGGGCTGTGGCCTATAGAGGGTGCTATCAGGAAAGGTCTGGTTCTGGTTGTCGAGAT
TGCCGGGGGTGACGTTCCGACCGTTCCAGATACCGTCGGTCATCATGATGTGATAGCTGGCCCGGCAGGAATATGTCTTT
CCGTCTTCGGTGGTATAAGCTGTGCCGTTGGTTTGCAAGAAGCGTCCGGCTCGGTCAAGAGCCGCATGCAGAGGAGTACC
GCCGCTGGCCGGGCTGTTCGCCAGCCAATTGAAGAAATTGATTTTGTGCTGCTTGTTGAATTGGAGCAGGGCATTGTTTT
GGCAGCTTCTGCTGTTGGCGCCGATGCTACAGGTGTTCAGGGCCCCCCAAGTGAGACGCACGTTTTCCGGCAGGCTGTAA
AAGGCCAGGTTGGCAGCGGTCTTTGTGGCCAGGATGCGGTTGCGATAGTAGGAGTACCATATCGCAAAGTTGCTTTCCTG
ACTGGTAGGAAGAGCATTGTAGGTATAACAGGAGTTGGAGCTGCTCACCGGCTGTGCAGGGCAGCTAGCGCTTACCTTAT
AAGTATAGTAATAAGCTCTCCCGGTATTGCAGCTGCTATCGATGCAACCAAGCCAGCCGGTTCCCCATTGAGGGCGATAG
TTATTGCTCAGGTTGGTGGTGGAGCCTTGGGCGTAGCCATCCTGCCAGGCTGCTGTGAAGCGTGGCACTGGATAGTCGGA
AACGATGATCTGATCGCCTGA

>ORF38640c (SEQ ID NO:408)
CTGACTTCCCTCAATATTGCTCCATGTGAAAGGCTTAAGGCGGTTGGTTCCGCTATTGCTGGCGATGTAAATATTACGGG
TAGCGGGAGCTCGGTTGTCCAGCAGTGCGCCGGCGCTCCATTCCTGGGTTTTGGTCGAACCGGTGGAAGTCGACTCCACC
TTGTAACGTATAAGGTCGCCCGCCCAGTTCTTGTCACTGGCAAAGCTGGACTGGTAGCTGTAGCGGATCAGCTTGTCGCC
GGTTCCGTCATCCTGCAGCGCGGAAGTCATTGCTGGTTTGGAGGAGGAGGTGTTGCGCTCGGAAATCCGTGTCAGGATCT
TATTGAAAGCCTGAACCAGAGAGTCCGGTGA

>ORF39309c (SEQ ID NO:410)
AGCTGCCTTGTCATTATCGCTTCCATAGCCGTTGCCGGTAACTACTGCCCATTGTCCGCTGTGCAGTCTGGCTACGGTAG
GTTTGGAGAAGGTGTAACCAAGGTCCGAGTCGGTACTGCTATCGTATTCCCAAAGCAGCTTGACATCGTCCGGCTTGGTT
ACATCGAGTGCGAACAGGCCGCGACCTCCAGCACCAAGCGTTCCGATCAGAACAGTGTGCCAAGCTCCATCGAAAAAGGC
ATCGCTGACGACCGGTGTAGCGTCGACGAAATATTGGTGGGCACCGCCCTGGTAGCTGATGCCGGTAAGCTTGTTAAGCT
TTTCGAATACTGCTGTAGGGATGAAAGCGAACTCTTCCACGCCGGTTTTGATGTTGAAACCATGCAACATGCCATCGTTG
GATCCAACATAAACTCTAGGGCTGCGCTGGTCTGCCTCTGTCTTGAATGTGCCGTAGTCGCCGCTGGGTTCGATGGGGTT
GGCCAGATAAGTGAGGTATTGGGCCGGTCCGACCACGGCTGGAGACGAGTGCACGATGTCCCCTAA

>ORF38768 (SEQ ID NO:412)
GGGACATCGTGCACTCGTCTCCAGCCGTGGTCGGACCGGCCCAATACCTCACTTATCTGGCCAACCCCATCGAACCCAGC
GGCGACTACGGCACATTCAAGACAGAGGCAGACCAGCGCAGCCCTAGAGTTTATGTTGGATCCAACGATGGCATGTTGCA
TGGTTTCAACATCAAAAACCGGCGTGGAAGAGTTCGCTTTCATCCCTACAGCAGTATTCGAAAAGCTTAACAAGCTTACCG
GCATCAGCTACCAGGGCGGTGCCCACCAATATTTCGTCGACGCTACACCGGTCGTCAGCGATGCCTTTTTCGATGGAGCT
TGGCACACTGTTCTGA

>ORF40047c (SEQ ID NO:414)
AAGCACTTGGCCGGCAGCGAACATATCTTCGATCATCATTTCGCCTTTCTTGCTGCTATTGACCTCCAGATTCAGTCGCC
AGCCATAGCTAGCCACATCCGAGTTCGCGGTACCGGTTGCTCCGTCTTTGTACCACTTCACCGGGTTTTGGCTAATAAGC
CGAATATTCCTGTTCACGCTACCGAATGTGGAGTTCGCCTCTGTTGTCATGGTTTGGGCTGTGAGGGCGTTGCGGTCGAT
GGTTGGGGTACTGTTTGCGCTTTCGCCCTTGGTCTGGCGATCCCAGATACCATAGAGCGTCATGGCTCGGCTGGTATCGG
CCTGAGCGTCATCGTCCTCGAAGTATTTCCTGTACCTACGATGACGATGTAGCCCTTACGGCTAGGATGGCGTACCAAG
GTAGGCGGAGCCGTGATGGGCTGACGAGTATTGTTGTCGGCGCGAGCACGGAAAAGCGGGGCGCCGCTGAACGATACTCT
GAAAGCAGAAGGATCTACATCTCCGGGCTTGAAGGGATTGATAGAGGTATTTGTGTCTGGGTCGTCGTTGCGGGTATTGC
CGATCAAATCGAAGCGCCAGATATTTCCCTGCAGATCGCCAGCATAGGCGTAGTCAGCAATGCCATCGCTGTTGTTATCA
GCCAGGCGAGGCGTCGATAG

>ORF40560c (SEQ ID NO:416)
CCGGCGAGTCCTGTTGTTGGACACGGTTGGGCAAGCGATATGTCTGCCCATCGACTACTACCAGACCGGCGGCAGGATGA
ACATCCTCGACCACGCCCACATTCTCGAACGTATTCGTGGCACTCAAGGCAAAGGTTGGGCAAGCCAGAGCTAGAGCTGC
AAGAGCTGTGGCGAGAAGACGTAAGGGGTTCATGTTCATTTCTCCTCGACGACCCGCCAGGTTTGTCGTCCGTTACTCTT
GTCGCTGGGGTTGAAGATGATGCACTCATCACCAGTGCAAGCCTCGGATTGACGCTGTTCGTTCTGGGTAATGGCCAAGC
CACCTAG

Fig. 3-36

>ORF40238 (SEQ ID NO:418)
GTGGCTTGGCCATTACCCAGAACGAACAGCGTCAATCCGAGGCTTGCACTGGTGATGAGTGCATCATCTTCAACCCCAGC
GACAAGAGTAACGGACGACAAACCTGGCGGGTCGTCGAGGAGAAATGAACATGAACCCCTTACGTCTTCTCGCCACAGCT
CTTGCAGCTCTAGCTCTGGCTTGCCCAACCTTTGCCTTGAGTGCCACGAATACGTTCGAGAATGTGGGCGTGGTCGAGGA
TGTTCATCCTGCCGCCGGTCTGGTAGTAGTCGATGGGCAGACATATCGCTTGCCCAACCGTGTCCAACAACAGGACTCGC
CGGTCATATTCTTGGTACGTCAGGGACAGACAGTGTCTTTCTCCGGCAAACTCACCAGCGACCTGCCAGAAATCGAGTCG
TTCTACATTATCAAGCAGGCCCCTCTCGTTCCCTTCGGATCGGAGCAGCAACAATGAAGTCGAACAGAGGCTTCACTCTC
ATCGAGTTGATGATCGTCGTAGTAATCATCGCTATTCTTGCTGGTATCGCCTACCCCAGCTACGACGAATACGTGAAGCG
CGGGAATCGCACCGAAGGACAGGCATTACTCAGCGAAGCAGCCGCTACTCAAGAGCGCTATTTTTCACAGAACAATACTT
ATATCACTACCCAAGCCGACATCGGCAAGCTGCATATGCGCAACACATCGGGCACCACAGTGAAGTCCTCCACAGGCAAA
TACAGCCTTACCGTCGATACGGTAGCCAACGACGGAGGTTATCGCCTTATCGCTAACCAGGCATTCAACGATCTTGATTG
TGGCAACCTGACCTTGACCGCCAACGGCGAGAAAGGCCGGACTGGAAGCAAGAAGAGCGTTGCAGAATGCTGGCGCTAA

>ORF40329 (SEQ ID NO:420)
CGGACGACAAACCTGGCGGGTCGTCGAGGAGAAATGAACATGAACCCCTTACGTCTTCTCGCCACAGCTCTTGCAGCTCT
AGCTCTGGCTTGCCCAACCTTTGCCTTGAGTGCCACGAATACGTTCGAGAATGTGGGCGTGGTCGAGGATGTTCATCCTG
CCGCCGGTCTGGTAGTAGTCGATGGGCAGACATATCGCTTGCCCAACCGTGTCCAACAACAGGACTCGCCGGTCATATTC
TTGGTACGTCAGGGACAGACAGTGTCTTTCTCCGGCAAACTCACCAGCGACCTGCCAGAAATCGAGTCGTTCTACATTAT
CAAGCAGGCCCCTCTCGTTCCCTTCGGATCGGAGCAGCAACAATGA

>ORF40709c (SEQ ID NO:422)
AGCCTCTGTTCGACTTCATTGTTGCTGCTCCGATCCGAAGGGAACGAGAGGGGCCTGCTTGATAATGTAGAACGACTCGA
TTTCTGGCAGGTCGCTGGTGAGTTTGCCGGAGAAAGACACTGTCTGTCCCTGACGTACCAAGAATATGACCGGCGAGTCC
TGTTGTTGGACACGGTTGGGCAAGCGATATGTCTGCCCATCGACTACTACCAGACCGGCGGCAGGATGAACATCCTCGAC
CACGCCCACATTCTCGAACGTATTCGTGGCACTCAAGGCAAAGGTTGGGCAAGCCAGAGCTAG

>ORF40507 (SEQ ID NO:424)
TCGATGGGCAGACATATCGCTTGCCCAACCGTGTCCAACAACAGGACTCGCCGGTCATATTCTTGGTACGTCAGGGACAG
ACAGTGTCTTTCTCCGGCAAACTCACCAGCGACCTGCCAGAAATCGAGTCGTTCTACATTATCAAGCAGGCCCCTCTCGT
TCCCTTCGGATCGGAGCAGCAACAATGAAGTCGAACAGAGGCTTCACTCTCATCGAGTTGATGATCGTCGTAGTAATCAT
CGCTATTCTTGCTGGTATCGCCTACCCCAGCTACGACGAATACGTGAAGCGCGGGAATCGCACCGAAGGACAGGCATTAC
TCAGCGAAGCAGCCGCTACTCAAGAGCGCTATTTTTCACAGAACAATACTTATATCACTACCCAAGCCGACATCGGCAAG
CTGCATATGCGCAACACATCGGGCACCACAGTGAAGTCCTCCACAGGCAAATACAGCCTTACCGTCGATACGGTAGCCAA
CGACGGAGGTTATCGCCTTATCGCTAA

>ORF41275c (SEQ ID NO:426)
GTGGGGGGCGTCGGAAGAGCAGGAACTGGAGGGACGGGAGGAGAACATTACCTTCTCGATGCCCAAGGAACTGCGGGTCA
AGGCTTTGTAATCGGAATTTTTGCGCACCTGAAAAAGCCCCGGCTTATGCCGGGCTTTGCCTTTTTCTTGTCTCGGCGCTT
TAGCGCCAGCATTCTGCAACGCTCTTCTTGCTTCCAGTCCGGCCTTTCTCGCCGTTGGCGGTCAAGGTCAGGTTGCCACA
ATCAAGATCGTTGAATGCCTGGTTAGCGATAAGGCGATAACCTCCGTCGTTGGCTACCGTATCGACGGTAAGGCTGTATT
TGCCTGTGGAGGACTTCACTGTGGTGCCCGATGTGTTGCGCATATGCAGCTTGCCGATGTCGGCTTGGGTAGTGATATAA
GTATTGTTCTGTGA

>ORF42234c (SEQ ID NO:428)
TCGACGTCCAGCCGGCCTGAACCGTCGGTCGCTGCGCCCTTCCCAAGCGGGGAGGGCGGTAGCAAGGTTCATTCGTCCAA
TCACCGCGTCGCCCACGAGACCGCCATGCAAATCAAATCGCCAATCCCCGCGGCTTCTGCGCCGGCGTGGATCGCGCCA
TCGAGATCGTCAACCGTGCCCTCGATGTCTTCGGCCCGCCGATCTACGTGCGTCACGAGGTGGTGCACAACAAGTTCGTC
GTGGACAACCTGCGCCAGCGCGGCGCCATCTTCGTCGAGGAACTCGATCAGGTGCCGGACAACGTCATCGTCATCTTCAG
CGCCCACGGCGTTTCCCAGGCGGTCCGCAAGGAAGCCGAGGGGCGCGGCCTGAAGGTTTTCGACGCGACCTGCCCGCTGG
TGACCAAGGTGCACATGGAAGTGGTGCGCTACAGCCGCGACGGCCACGAATGCGTGCTGATCGGGCATGAAGGCCACCCC
GAGGTGGAAGGCACCATGGGCCAGTACGATGCCAGCAACGGCGGTGCCATCTACCTGGTGGAGGACGAGGCCGACGTCGC
CGCGCTGGAGGTGCGCAAGCCCGAAGCCCTGCACTACGTGACCCAGACCACCCTGTCGATGGACGACACCTCGAAGGTCA
TCGATGCCCTGCGCGCCAAGTTCCCGCAGATCCAGGGGCCGCGCAAGAACGACATCTGCTATGCCACCCAGAACCGCCAG
GATGCCGTGAAGGAACTGGCCGACCAGTGCGACATGGTCCTGGTGGTGGGCAGCCCCAACAGTTCCAACTCCAACCGCCT
GCGCGAACTCGCCGAGCGCATGGGCACGCCGGCCTACCTGATCGACGGCGCCGAGGACATGCAACGCGGCTGGTTCGACG
GTGTGCGTCGCATCGGAATCACCGCAGGCGCCTCCGCGCCGGAAGTGCTGGTGCGCGGAGTGATCGCCCAGCTACGTGAG
TGGGGGGCGTCGGAAGAGCAGGAACTGGAGGGACGGGAGGAGAACATTACCTTCTCGATGCCCAAGGAACTGCGGGTCAA
GGCTTTGTAA

Fig. 3-37

>ORF41764c (SEQ ID NO:430)
AGGCCACCCCGAGGTGGAAGGCACCATGGGCCAGTACGATGCCAGCAACGGCGGTGCCATCTACCTGGTGGAGGACGAGG
CCGACGTCGCCGCGCTGGAGGTGCGCAAGCCCGAAGCCCTGCACTACGTGACCCAGACCACCCTGTCGATGGACGACACC
TCGAAGGTCATCGATGCCCTGCGCGCCAAGTTCCCGCAGATCCAGGGGCCGCGCAAGAACGACATCTGCTATGCCACCCA
GAACCGCCAGGATGCCGTGAAGGAACTGGCCGACCAGTGCGACATGGTCCTGGTGGTGGGCAGCCCCAACAGTTCCAACT
CCAACCGCCTGCGCGAACTCGCCGAGCGCATGGGCACGCCGGCCTACCTGATCGACGGCGCCGAGGACATGCAACGCGGC
TGGTTCGACGGTGTGCGTCGCATCGGAATCACCGCAGGCGCCTCCGCGCCGGAAGTGCTGGTGCGCGGAGTGATCGCCCA
GCTACGTGA

>ORF41284 (SEQ ID NO:432)
CTGGGCGATCACTCCGCGCACCAGCACTTCCGGCGCGGAGGCGCCTGCGGTGATTCCGATGCGACGCACACCGTCGAACC
AGCCGCGTTGCATGTCCTCGGCGCCGTCGATCAGGTAGGCCGGCGTGCCCATGCGCTCGGCGAGTTCGCGCAGGCGGTTG
GAGTTGGAACTGTTGGGGCTGCCCACCACCAGGACCATGTCGCACTGGTCGGCCAGTTCCTTCACGGCATCCTGGCGGTT
CTGGGTGGCATAGCAGATGTCGTTCTTGCGCGGCCCCTGGATCTGCGGGAACTTGGCGCGCAGGGCATCGATGACCTTCG
AGGTGTCGTCCATCGACAGGGTGGTCTGGGTCACGTAGTGCAGGGCTTCGGGCTTGCGCACCTCCAGCGCGGCGACGTCG
GCCTCGTCCTCCACCAGGTAGATGGCACCGCCGTTGCTGGCATCGTACTGGCCCATGGTGCCTTCCACCTCGGGGTGGCC
TTCATGCCCGATCAGCACGCATTCGTGGCCGTCGCGGCTGTAGCGCACCACTTCCATGTGCACCTTGGTCACCAGCGGGC
AGGTCGCGTCGAAAACCTTCAGGCCGCGCCCCTCGGCTTCCTTGCGGACCGCCTGGGAAACGCCGTGGGCGCTGAAGATG
ACGATGACGTTGTCCGGCACCTGATCGAGTTCCTCGACGAAGATGGCGCCGCGCTGGCGCAGGTTGTCCACGACGAACTT
GTTGTGCACCACCTCGTGACGCACGTAGATCGGCGGGCCGAAGACATCGAGGGCACGGTTGACGATCTCGATGGCGCGAT
CCACGCCGGCGCAGAAGCCGCGGGGATTGGCGAGTTTGATTTGCATGGCGGTCTCGTGGGCGACGCGGTGATTGGACGAA
TGAACCTTGCTACCGCCCTCCCCGCTTGGGAAGGGCGCAGCGACCGACGGTTCAGGCCGGCTGGACGTCGA

>ORF41598 (SEQ ID NO:434)
CCTTCGAGGTGTCGTCCATCGACAGGGTGGTCTGGGTCACGTAGTGCAGGGCTTCGGGCTTGCGCACCTCCAGCGCGGCG
ACGTCGGCCTCGTCCTCCACCAGGTAGATGGCACCGCCGTTGCTGGCATCGTACTGGCCCATGGTGCCTTCCACCTCGGG
GTGGCCTTCATGCCCGATCAGCACGCATTCGTGGCCGTCGCGGCTGTAGCGCACCACTTCCATGTGCACCTTGGTCACCA
GCGGGCAGGTCGCGTCGAAAACCTTCAGGCCGCGCCCCTCGGCTTCCTTGCGGACCGCCTGGGAAACGCCGTGGGCGCTG
A

>ORF42172c (SEQ ID NO:436)
CAAGGTTCATTCGTCCAATCACCGCGTCGCCCACGAGACCGCCATGCAAATCAAACTCGCCAATCCCCGCGGCTTCTGCG
CCGGCGTGGATCGCGCCATCGAGATCGTCAACCGTGCCCTCGATGTCTTCGGCCCGCCGATCTACGTGCGTCACGAGGTG
GTGCACAACAAGTTCGTCGTGGACAACCTGCGCCAGCGCGGCGCCATCTTCGTCGAGGAACTCGATCAGGTGCCGGACAA
CGTCATCGTCATCTTCAGCGCCCACGGCGTTTCCCAGGCGGTCCGCAAGGAAGCCGAGGGGCGCGGCCTGAAGGTTTTCG
ACGCGACCTGCCCGCTGGTGACCAAGGTGCACATGGAAGTGGTGCGCTACAGCCGCGACGGCCACGAATGCGTGCTGATC
GGGCATGA

>ORF42233c (SEQ ID NO:151)
CGACGTCCAGCCGGCCTGAACCGTCGGTCGCTGCGCCCTTCCCAAGCGGGGAGGGCGGTAGCAAGGTTCATTCGTCCAAT
CACCGCGTCGCCCACGAGACCGCCATGCAAATCAAACTCGCCAATCCCCGCGGCTTCTGCGCCGGCGTGGATCGCGCCAT
CGAGATCGTCAACCGTGCCCTCGATGTCTTCGGCCCGCCGATCTACGTGCGTCACGAGGTGGTGCACAACAAGTTCGTCG
TGGACAACCTGCGCCAGCGCGGCGCCATCTTCGTCGAGGAACTCGATCAGGTGCCGGACAACGTCATCGTCATCTTCAGC
GCCCACGGCGTTTCCCAGGCGGTCCGCAAGGAAGCCGAGGGGCGCGGCCTGA

Fig. 3-38

\>ORF42233c (SEQ ID NO:151)
CGACGTCCAGCCGGCCTGAACCGTCGGTCGCTGCGCCCTTCCCAAGCGGGGAGGGCGGTAGCAAGGTTCATTCGTCCAAT
CACCGCGTCGCCCACGAGACCGCCATGCAAATCAAACTCGCCAATCCCCGCGGCTTCTGCGCCGGCGTGGATCGCGCCAT
CGAGATCGTCAACCGTGCCCTCGATGTCTTCGGCCCGCCGATCTACGTGCGTCACGAGGTGGTGCACAACAAGTTCGTCG
TGGACAACCTGCGCCAGCGCGGCGCCATCTTCGTCGAGGAACTCGATCAGGTGCCGGACAACGTCATCGTCATCTTCAGC
GCCCACGGCGTTTCCCAGGCGGTCCGCAAGGAAGCCGAGGGGCGCGGCCTGA

Fig. 3-39

>ORF2 (SEQ ID NO:3)
SPIQCQGVPGQSEPTHGCRGRHCQAPGRRREQHQYRLQRQRHQLRDDRNQQQLGPQQHPLRRRQRHPAVDEQVVRGGLRR
RLRAARCAGRSASRSATGDRL*

>ORF3 (SEQ ID NO:5)
RRSNAKEYLGNQSLLTAAGAGIAKLLDADENNTSTVFSGNGTSFGTTGTNSNSALNSILSGGVSDIRQWMNKLYGEAFAA
VYVQPGARVAVHLDQQLAIDYELKGRKVDYSSGAAHATADLD*

>ORF602c (SEQ ID NO:7)
SAWSFAEASCCGSIGRRSVCLASRSSRPRLLPIELVAPRSQTSSMLASPWGSISSLLVEHAARVSAQARPAQRRRRGLVQ
VCCCMSGSRAVIDLAALEFIVDRQLLIEMHCDPRTWLHVDGGEGLPVQLVHPLPDVADAAGEDAVEGRVAVGSGRPEAGA
VAAEDGTGVVLVGVQELGNAGPGSRE*

>ORF214 (SEQ ID NO:9)
TSCTGRPSPPSTCSQVRGSQCISISNWRSTMNSRAARSITALEPLMQQQTWTNPLLRLCAGLACALTLAACSTSKEEMLP
HGEANMLDVWERGATSSIGNSRGRLLLDARQTLRRPIDPQQDASANDQADYTRTASNEIHSQFKRLPNPDLVMYVFPHLA
GSDPAPVPGYTTVFPFYQRVQYAMPGERTEDY*

>ORF1242c (SEQ ID NO:11)
SRPGRRTGQSRVRFRARRRSSAGLLSMRPGRSASNWDRGPRCPRAPVRRMRRANAHPPGASLARRAGTQPRAAGLRTMGR
DRRGVTLRPAWRHSCSRCWAEEYPWRPVAPDSAQSLLPRPLRPALLNLRERLPVPTEAVCDRAEGFEKSPSIVLRAFARH
GVLDSLVEGEHGGVARYRGGIAAGQVREHIHHQVGIGQSFELTVDLVAGRAGVVGLVIRGGILLRIDWAPQRLPGIEEQP
ATAVAYRAGRTSLPDVEHVGLAVGQHLLLAGGARCQGQRAGQAGAETKKGVSPSLLLHERLQSCNRPCGP*

>ORF594 (SEQ ID NO:13)
PGRLHPHGQQRDPQSVQTTAQSRPGDVCVPAPGRQRSRPGTGLHHRVPLLPASPVRHAGRTHGGLLMGFFQTLLRGRTQP
QSVPADAPEDSGALDVAAAEEATERYLARLAAMGIPLPNTGSKNGATQAEASRLYDHDPSFVDLLPWAEYLPDEQVMLLE
DGRSRAAFFELVPLGTEGRDPNWMQNARDALKEALQNSFDEHETSPWIVQFYAQDEISWDNFQEQLRQYVHPRARGSAFS
EMYLALMKHHLEGISKPGGLFVDTAVSKLPWRGQQRRVRMVVYRRIRKEDAQIRGQDPAAYLKSICERIQGGLANAGIVA
SRMGGQEIRNWLIRWFNPHPDHLGQAEADLRRFYELVCRPDEPILQDELPLADGTDFSQNLFYRQPVSDATQGVWLFDAM
PHRVIVVDQLNKAPLTGHFTGETLKGDGLNALFDRMPEDTLLCITMVVTPQDMLEGHLQQLSKKAVGDTQASIHTREDVA
TVRRLIGREHKLYRGAIALFVRGRDHTQLEERCITLSNVLLGAGLVPVEPQNEVGPLNSYLRWLPSNFDPNEKRALEWYT
QMMFAQHIANLSPIWGRTTGTGHPGFTLFNRGGAPLTFDPFNKLDRQMNAHGFIFGPTGSGKSASLTNLICQMLAMYLPR
MFVAEAGNSFGLLADLAKRFGLSVHRVRLAPGSGVSLAPFADAIKLVESPDQVKVLDAEDIEASDSVQGSKADLEDDQRD
ILGEMEIVARLMITGGEEKEDARLTRADRSAVRQAILAAARTCAAANRTVLTQDVRDALYEASRSDSTAPERRARIAEMA
EAMQMFCMGADGEMFNREGTPWPEADLTVVDFATYAREGYAAQLGIAYISLLNTVNNIAERDQFKGRPIVKITDEGHIIT
KHPLLLPYAMKITKMWRKLGAWFWLATQNIDDIPASGAPMLNMIEWWLCLNMPPDEVEKISRFRELSPAQKSMMLSARKE
SGKFTEGVLLAKGKEYLVRVVPPSLYLALAMTENEEKNQRYNIMQATGCDELEAALQVAADLDKARGLPPFPIVFPDQPA
VECQDE*

>ORF1040 (SEQ ID NO:15)
VPARRASDAPGGWAFARRILRTGALGHRGPRSQLDAERPGRIERSPAELLRRARNLTLDCPVLRPGRDQLGQFPGAVEAV
RPSSSARIGLQRDVPGAHEASPGGHFEAGRTVRRHRRQQAALARTTAPRADGRLPPDPQGGCADSRTGPGGVPEIHLRAY
PRRPGERRHRRFAHGRTGDQELVDPLVQPAPGSPRPGRGGPTSLLRTGMPSGRTDPAG*

>ORF1640c (SEQ ID NO:17)
VRLGLAEVIRVRVEPADQPVPDLLSAHARSDDAGVRQAALDTLADGFQVRRRVLSANLRILLADPAVDDHPHAALLSSPG
QLADGGVDEQSARLRNALQVMLHERQVHLAEGRSSRSRMDVLPQLLLEIVPADLVLGVELDNPG*

Fig. 4-1

>ORF2228c (SEQ ID NO:19)
GEPAQVAVQRSDFVLRFDRHQAGAEQYVAQGDAAFLQLGMVAAAHEQSDRSAIELVLPADQASNGGHVLAGVDRGLGVTN
GLFRELLQMPFQHVLRRHDHGDAQQRVLGHSIEQGVEAIAFERLAGEVACQRRFVQLVDHNHSVRHGIEEPYALGGIGNR
LPIEQVLGEVSAVGQWQFILQDRFVRTAYQFVEAT*

>ORF2068c (SEQ ID NO:21)
SLCSRPIRRRTVATSSRVWIEAWVSPTAFFESCCRCPSSMSCGVTTMVMHSSVSSGIRSNRALRPSPLSVSPVKWPVSGA
LFNWSTTITRCGMASKSHTPWVASETGCR*

>ORF1997 (SEQ ID NO:23)
HPGLDPHPRGRGHRSTPDRPGAQALSRSDRSVRARPRPYPVGGTLHHPEQRTARRRPGAGRTAERSRTAEQLPALAPLKL
RSKREASPGVVHPDDVRSAHRQPVAHLGAHHRYRTPWLHAVQPWRRAVDLRPVQQAGPADECPRLHLRANWLRQVGVPDQ
PHLPDARHVPAADVRRGSGQQLRPAGRLSQAVWPLGPPGAPRPGLRRQPGAVRGRHQAGREPRPSEGAGRRRHRGLGLGP
GQQGRPRGRPARHPGRDGDRRPPHDYRWRREGRCAPDPCRSQRRPPGDPGGGQDLRRREPHGTDPRRARCALRGLQER*

>ORF2558c (SEQ ID NO:25)
VGQQAEAVARFRDEHPRQVHGEHLADEVGQGRRLAGASWPEDEAVGIHLPVQLVERVEGQRRAATVEQREARVSGTGGAP
PDGRQVGDVLSEHHLGVPLQGSLLVWIEV*

>ORF2929c (SEQ ID NO:27)
SASRTSWVSTVRFAAAQVLAAARIAWRTALRSARVRRASSFSSPPVIMRRATISISPRMSRWSSSRSALLPWTESEASMS
SASSTFTWSGLSTSLMASANGARLTPEPGARRTRWTERPNRLAKSASRPKLLPASATNIRGRYMASIWQMRLVRDADLPE
PVGPKMKPWAFICRSSLLNGSKVNGAPPRLNSVKPGCPVPVVRPQMGDRLAMC*

>ORF3965c (SEQ ID NO:29)
APVGPYQAVDVVAAIHPRAALSAGRYPGDRLPSVESAAAPLSVQERISLASAGHPLRGSAGSGSGCRSGSGSANSELSFV
LALHCRLVWENNGEGWQAARLVEIRCDLQGRLELVAAGGLHDVVALVLFFVFGHGQGQVETRGNHTDEVFFALGQEHALG
ELAAFLAGREHHRLLRRRQLAEPGYLLYFVGGHVQAQPPLDHVQHRRPGGWDVVDVLGGEPEPGAQFPPHLGDLHGVGQQ
QRVLGDDVPLIGDLDDWPALELVAFGDVVHGVQQRDVGDPELGGVAFARVRCEIHHGKVGLRPGRAFAIEHLAVGAHAEH
LHGFRHFGDPRAAFWRGAIAPGGLVERIAHVLGQYRAVRGGAGPGRRQDRLADGAAIGTGQARIFLLFATGNHEAGDDLH
LAQDVSLVVLEVGLAALDRVRGLDVFGVQHLHLVGALDQLDGVRERRQADAGARGEAHPVDREAKPLG*

>ORF3218 (SEQ ID NO:31)
GAHHHQAPAAAALRHEDHQDVAETGRLVLARHPEHRRHPSLRGADAEHDRVVVVPEHAPRRSREDIQVPRAVAGAEVDDA
LGPQGKRQVHRGRAPGQGQRIPRPCGSPESLPGPGHDRKRRKEPALQHHASHRLRRARGGLAGRSGSRQGARPATLPHCF
PRPTGSGVPGRMRVLNSLTQNLIDNLTQILQNPEEDALQTLRICAPVLIEELQQIQLRAVDRRDIVPQIKQLLDEWLQQH
PQPDTAQQALIEAVDRAEILQRRQA*

>ORF3568 (SEQ ID NO:33)
PKTKKRTSATTSCKPPAATSSRRPCRSQRISTRRAACHPSPLFSQTNRQWSARTNESSEFADPEPDRQPDPDPAEPRRGC
PADAKDMRSCTDRGAAADSTEGSRSPGYRPADKAALG*

>ORF4506c (SEQ ID NO:35)
VNKFVVFRTFLQSSLVQFRKVQCAARQPAPVAGRLSEDRIDSAPEGFGAALDPRALHQASLVAGRLAMHLQGKMAPNQVH
VRMAVYPALKPRGVDLAEGALQVGVFIDRPARFRIAVEAVVGWQALHQKLYPYGGCSQQDQQQPRPGQGGTLKSFGCPAA
LQESHACLRCRISARSTASMSACWAVSGCGCCCSHSSKSCFICGTISRRSTALS*

>ORF3973 (SEQ ID NO:37)
GRGPRGDPTAEASVRLLKGGWAAKRFQGPALPWAGLLLVLLAASAVGVELLVKGLPANHSLYGDAKARWTINEYADLECP
FCKVYTPRLKRWVDSHPDVNLVWRHLPLQMHGEAARHQARLVECAGIQGGAKAFWSAIDAIFAQSAGNGGGLPGGTLDFP
ELDQARLEKCAKDNELIDSDIKLDIDIARSKGITATPTLVIRDNQTGRSVKLEGMADETTLLSAIDWLAKDL*

Fig. 4-2

>ORF4271 (SEQ ID NO:39)
TWFGAIFPCRCMARRPATRLAWWSARGSKAAPKPSGALSMRSSLSRPATGAGCLAAHWTFLNWTRLDWRNVRKTTNLLTQ
ISSWTSTLHGRRALQRPRPSSSGTTRRDEA*

>ORF4698 (SEQ ID NO:41)
EIGEDSNIPLLVLQDALHFTWQNLDLLPIHNLYHSLVAGAGEAKPQLHCRPSIDVNALEQALHDFDHSLISVSQLHTGIM
LPRTCRRHPYLCTWQRSITARKNTPPTS*

>ORF5028 (SEQ ID NO:43)
FPAALSEVILSAVCTFLEPVQTHASSSLPWPAATNAGRWRTTGTAEQRESGRNLGHHRQGSSGLCHRIVARSVSGRPGT
PRGATDCGLAPGSTACSSGV*

>ORF5080 (SEQ ID NO:45)
NRYRPMPLHHSPPGRRPPTLAVGVLLVLLSSASQAETWVITDKAHPVSATGSSRVLFLDAQEHLEEQLTAALPQDPQHAQ
AAFKRLLQSPDGRRLQAELVKAQQDVADAWSLGVEKIPAVVVDRQYVVYGEPDVSRALELIAKARRSR*

>ORF6479c (SEQ ID NO:47)
FVSVSLLEVGTADEHLPLALAAGVGTPERPGVLPVDGLRLRPRVGKHRAVEAQGWGQLLPFPGRGIALFQLARRPVAVLG
GCAHGEVDVELADSRGDIAGALGDDGCRLVVVGLVQEAAARIEVPPHVAGEDSTHLAQPWDQRFGVHLLGNSMPPANGVQ
CAEKVRHQRDGGARANVPRGAGEPAERGATRMADHIRFLEAADAVLGLVVCGRVIAGLGEWIRCTQRRYLGPGVAPGIRV
AGDDCVRHVVADLDRRLHFAAMRAAEQPVTDPDDLVFEALRGKGGGDDGSAVDRGRGREREAEGGGRRCQAAEVEAGHQR
DLLALAISSRARETSGSP*

>ORF5496 (SEQ ID NO:49)
ANRQGQEVALMTSLNLRRLAAAAATFSLSFTASAAINSAAIVSSTLSPQCLEYKVVGICYWLLCGPHGCKVKTSVKVRHY
VPDAVVSSYANTGSNPWTEVSALGTPNPLAQAGNDATTNYKAENSIGRFKEADVIGHPGGATFSRFASASGYVCPGATVP
LVPYFLSTLDAIGWRHGIPEQVYPEALVPGLREVGGIFSGDMWGNLYPRSGFLHQTDDYKTAAVIAQRAGDITTRIGQLH
VYLPMRAAPKDGYWPAGELKEGDASTGKWQELTPSLSLNCAVFPNSGPKTQAVDGEHAWALWRPYSCCQRKGQMFICSTD
FQ*

>ORF5840 (SEQ ID NO:51)
RDHKLQGREQHRPLQGSGCDRPSWWRHVQPVRQRLWVRLPWRHRPAGAVLSQHTGRHWLAAWNSRAGVPRSVGPRAARGG
WNLLRRHVGEPLSAQRLPAPDRRLQDGSRHRPARRRYHHANRPAPRLPPHARSPQGRLLAGGRAERGRCLDREMAGADPI
PEPQLRGVSQLWAEDASRRRGARLGALASLLLLPAQGADVHLQYRLPIRTRRRIMRMNITSVALMWLLAAQLAQADDPIN
VSKTGTVLSDEVLYSIGGGSAVSMGSAGQMDSIGVGFGWNNDMMCGNMNLSTTLENQLNGATQGFQNIMGSVIQNATGAV
MSLPALIIQRANPQLYNLITNGILQARIDYDRSKGTCKTIAEKMADIAGEQTGWGKIAEGQALGATLASDGKDAVSALEA
VEKKGGNDGVTWVGGDKAGGSGQKPIRIVNDVTRAGYNLLTSRSVNDSSSVPSATCNNGLVCNTWSSPQEAAAFATRVLG
EQQQQTCEGCQKTVTAAGVGLTPLIQETYDKKLQSLQELLSKSKPLTAENLAAAGTDALPITRGVIEALRDERDQDVLAR
RLASDVSLMDVLSKALLLQRLMFAGAKEPNVAANGLATQAVDQQTSLLQQEISNLKTELELRRELASNSPMRVIERGQQR
ASGSSGVFESAPDADRLDRLQAPSAAGGKSGGRP*

>ORF5899 (SEQ ID NO:53)
SAILVAPRSAGSPAPLGTFALAPPSRWCRTFSAHWTPLAGGMEFPSRCTPKRWSQGCARWVESSPATCGGTSIRAAASCT
RPTTTRRQPSSPSAPAISPRESASSTSTSPCAQPPRTATGRRAS*

>ORF6325 (SEQ ID NO:55)
ASTARCFPTLGRRRKPSTGSTPGRSGVPTPAASARGRCSSAVPTSNKDTETNHANEHHLGRANVAARSATCPGRRPDQRV
QDRHGAQRRGPLQHWRRQCGEHGQRRPDGLDRRRLRLEQRHDVRKHEPEHHPGEPAQRCHTGFPEHGLSHPERDRRGHV
AAGVDHPAREPSALQPDHQWHPAGADRLRPLERDLQNDRRKDG*

Fig. 4-3

>ORF7567c (SEQ ID NO:57)
QCLAEHVHQGDIGRQAARQDVLVTLVAQRLDDAAGNWQSIGAGRSQVLCSQWFALRQQLLQRLELLVVGLLDQRGEADAS
SRHRLLAAFAGLLLLLPQYPGGECGGLLGGGPSVADQAVVASGGRHARRIIHRAAGQQVVARPGHVVDDANGLLAGAAGL
VSTNPGYAIVAAFLLHCFEGGYGVFPVRGQCGAQGLAFGDFPPAGLLASDVSHLFGDRFASPFRAVVVDPRLQDAIGDQV
VELRVRALDDQRRQRHDRAGRVLDD*

>ORF7180 (SEQ ID NO:59)
FVERAFRHLQQRPGLQHLVLPPGGRRIRHPGTGGATATDLRRLPEDGDGCWRRPHPADPGDLRQEAPVAAGAAVEEQTTD
CREPGCGRHRCSANYPRRHRGAARRA*

>ORF7501 (SEQ ID NO:61)
PGRPGAPPGVRCLPDGRAQQGTATAAPDVRRRQGAQRRRQRPGHPSRRSADQPPAAGDLQSQDRTGTPSRVGQQLPHAGH
RARATTRLRVQWRVRVGARCRSPRSPAGPLCRRRQVGRETVMADTLTTRKLLGQLLVGVLIVIGLAVVGTLLSLFALNHF
GGIQGLEAWRQSNYWSLFAWRALLYCALAIAWFRQRKELSAHERQRIRRIEILVLLLVLLIEFSKAYFRTGGAA*

>ORF7584 (SEQ ID NO:63)
CSPAPRSPTSPPTAWPPKPSISRPASCSRRSPISRPNWNSVASWPATPPCGSSSAGNNAPQGPVACSSRRPMPIASIACR
PPLPPAASREGDRDGRYAHHPKASRSATGRSADRHRTGSGRYAAQSLRPEPLRWHPGPGGLAAKQLLELVRLAGAAVLRP
GHRLVPAAQGTERA*

>ORF8208c (SEQ ID NO:65)
RSCCASRAEVGFAEFDEQDQQQHQDLDPPNALPLMRAQFLALPEPGDGQGAVQQRPPGEQAPVVALPPGLQALDATEVVQ
GEETEQRTDHCQSDDDQHSDQ*

>ORF8109 (SEQ ID NO:67)
AAAHSADRDPGAVAGPAHRIQQSLLPHGRRSMTFMTNDYLEYYLTLLGWIINNGIWNMISDTGLFAVPFAAIVMREWLKV
RGEGADEGNKGVLSLARIETHIYVGYIVVALAGIPVVNVSFDTIEFDQTRAQQCQYNLPAPADTGWSSSFSSLAGKSAQM
PLWWAMMHALSKGFTSGAIAAIPCGTDLRQMRMEVDNTRVNNPLLAQEIADFSRDCYGPSRARLFMRQPDLGSVAEDNKA
LQDLNWIGSRFLLNTPGYYDTDYSKSPRQSWPYNATRDAGLPQVGGGGGYPTCKQWWADSGIGLRDRIKDQVDPDLMTSF
LKWAKWLNQDEVTEAVIRQVISPSSQVKGNVYTDYGGQVGGTVWNGIARTAGTFGVAVGSLAYFPAMDVVRQALPMVMSF
LKMAMVICIPMVLVIGTYQLKVAMTMTVVFFAMMFVDFWFQLARYIDSTILDAFYGSGSPHLSFNPVMGLNTATQDAILN
FVMGSMFIVLPLLWMTAIGWSGIQAGSVLNGLSRGTEGVQAAGKEAGNRVKNAV*

>ORF9005c (SEQ ID NO:69)
VSPPLLAGWVAATTAHLRQAGIAGGVVGPRLTGTLRVVGVVVPRGVQQESGADPVQVLQRLVVLGDGAQVGLPHEQPRTG
RPVAVSGKISDFLCQQRIVHARVVHFHSHLPQIRAARNGRDGAAGEALGQGVHHRPPERHLRTLAGQAAEGARPAGVRRC
RQIVLALLGASLVELDGVEAHVDDRDPRQGDHDVADVDMRLDAGERQHSLVALVGAFPTNFQPFAHHDGRERHREQASIR
DHVPDPVVDDPAEEGEVILQVVIGHEGHAAPPVRK*

>ORF8222 (SEQ ID NO:71)
LPGVLPHPPRLDHQQRDLEHDLGYWPVRGAVRGHRDARMAESSWGRRRRGQQGSAVSRPHRDAYLRRLHRGRPGGDPGRQ
RELRHHRVRPDSRPAVPIQSAGTGGHRLVELLQQPGRQECADAALVGDDARPVQGLHQRRHRGHSVRHGSAADANGSGQH
AREQSAAGTRNR*

>ORF8755c (SEQ ID NO:73)
QSLEKSAISCASSGLFTRVLSTSIRICRRSVPHGMAAMAPLVKPLDRACIIAHQSGICALLPARLLKELDQPVSAGAGRL
YWHCWARVWSNSMVSKLTLTTGIPARATTM*

>ORF9431c (SEQ ID NO:75)
LKPEVDEHHRKEDDRHRHGNFQLIGADDQDHRNADDHCHLQERHHHRQCLADHIHRREVCQAAHRNAEGSCGSRDAVPHG
AAHLPAVIGVDVTLDLAGG*

Fig. 4-4

>ORF9158 (SEQ ID NO:77)
RLHRLRRAGGRHRVERHRENRRNLRRCGGQLGILPGDGYGPPGTADGDVVPEDGNGHLHSDGPGHRHLSTESCHDDDGRL
LCDDVRRLLVSVSQIYRQHDT*

>ORF10125c (SEQ ID NO:79)
VIAGCLPLGARRLMMNAHTNKGFASRIGFGLGMLVRFCLHDRRPALRWVKRVSLFLLVALVVSQNFMWLAGVSMTLLCVF
LVGFALVKGDISVSKGSPSRDVSTMTSQAETESVAELFDYQAAHHYRD*

>ORF9770 (SEQ ID NO:81)
SNSSATDSVSACEVIVETSRLGDPLETEMSPLTKANPTRKTHSRVIDTPASHIKFCDTTRATNKNRLTRLTQRRAGRRSC
RQKRTSIPRPKPIREAKPLLVCAFIINLLAPKGRHPAITYTPKKMIWQALWHIMPLAICRLEYLMATRNVVLPDPLEQDI
NELVETGRYQNRSEVIRAGLRLLLQQEAQIAKLETLRNATSSGLMQLERGEYDEITSDELAQYLDELGNQASH*

>ORF9991 (SEQ ID NO:83)
SWTAIMQAETHKHTQTKTDPGGKAFVGVRVHHQSPGSQREASCYHLYAEKDDLASIMAYYATSYLPTGVPHGNAKRRPSR
SAGAGYQRAGGDRPLSESQRSHPGRLAPAAATGSPDRQARNPPQRNIQWADATGARRVRRDHQRRTGPIPRRARQPGEPL
KHGQVPHLS*

>ORF10765c (SEQ ID NO:85)
HLVCRHPVEDEVPGPNNLTDIGHRVAVNEVDAAQASSQFFTADAAYLLWVCRNCFQRRPYECLVTSARGIAEVVVGEAQD
IDDVRLGIMRDAVLGHASVARLVAELVEVLGQFVAGDLVVLAALQLHQPTGCCVAEGFELGYLGFLLQQQAQACPDDFAA
ILIAAGLHQLVDILLQRIGKDDVSRCHEVLQSADS*

>ORF10475 (SEQ ID NO:87)
SMAKYRISHDAQADIVDILRFTHNHFGDAARRRYQALIGAALEAVATDPQQVGSISREELGAGLRSIHLVYCHSMPNVGK
VVRPRHFVFYRVATDQVLEVVRVLHDAMDVDQHLPQR*

>ORF11095c (SEQ ID NO:89)
SRMQAVVSTNANAWSGGMQSSGQATAIAHQPWGTCWWMFTRSLFVFAGANAALSAFRQALSGRAFTLVNHSLRPSSPFPL
WAICSCYSCSSLGQVLIHIHGVVKHANHL*

>ORF11264 (SEQ ID NO:91)
TAVRRDLLKLMGCTHIEADYIGGLRCSTAPEGTWVAHGFHGPIVDVIDDSAGFFSTHRLALHYPAQCGLAVDQAIPRTAI
HVASPLMHVCIGKVVVISAWMC*

Fig. 4-5

>ORF11738 (SEQ ID NO:93)
EEVIMKLQAYRLQNYRRLRDVVIELDDEISIFVGANNSGKTSAVQGLYSMLRGEVKKFELFDFSAALWAEIDAVGRTPPG
DEDAPKRLPSILLDLWFRVGEDDLATAMSLLPSTEWDGKCVGIRVAFEPRDAHELVWKFHELHEKANNAAVALAAKRKAA
GEQAVEAGAEDAAAVVADAGEYKPWPESLTKYLTKELSKEYTFRYYVLDERAFVGYQAREADYEPLPLGKEPGGAAILKS
LVRVDFLRAQRHLDDPDAGSSDRAESLSRRLSRFYHRNLEKRGDDHAALKALDTSEKELNFHLKEVFNDTLTRLAKLGYP
GVNNPEIVIRAALDPTTVLGQDAKVHYVIPGVASAQLPDSYNGLGFKNLVYMVVELLDLHEQWKAEDDKRAPLHLVFIEE
PEAHLHAQIQQVFIRNVLRLLEDANDHATLFHTQLVITTHSPHILYERGFSPIRYFRRVNDQLGHHTDVRNLSLFKTGAS
DAPAREFLQRYLKLTHCDLFFSDAVILVEGNVERLLLPAMIELVAKRLRSSALTILEVGGAFAHRFQELIAFVGLTTLVI
TDLDSVTVKTDAEKAAAQGAGAEGAVDGDDEDEDDDLKPFELEDDDEAEPSGKKKSKKRGSTCHAHVEGAVTSNQTLISW
IPKKRSMAELWEVTAEQKTLSLAEDSSAGVRVAYQTKVSVTVGATTSQLCGRTLEEAFGLENADWCQAEANRSVGLKLKR
APSSPEELAEKLHDRVVGKNFDKTRFALEVLASGPLNGWKVPAYIAEGLAWLEAKVAHELEADAAIATEVATIEPTTADV
VAIIVDPGQTA*

>ORF12348c (SEQ ID NO:95)
RKVYSLLSSFVRYFVRLSGQGLYSPASATTAAASSAPASTACSPAALRLAASATAALLAFSCSSWNFQTSSWASRGSNAT
RIPTHLPSHSVLGSSDIAVARSSSPTRNQRSKSMDGNLLGASSSPGGVLPTASISAHSAALKSKSSNFFTSPRSIEYRPW
TADVFPLLLAPTKIEISSSSSMTTSRSRR*

>ORF12314c (SEQ ID NO:97)
GTSSGFLAKACTRRHRPPPQPRLPRPPPQLAPRRPCAWPQARQLRCWPSHVVHGTSRRARGHPEARTLPGSRRTCRPTQC
SAAATSQWRGRLHRRGTRDPRVWTVTFWAHPHRQGASCRPHRSRPTAPH*

>ORF13156c (SEQ ID NO:99)
RQIAHIRVMAQLVVDAAEVPNGRESAFIEDVRGVRGDDELRVEQSRVIVSILKEAQNVPDEDLLDLRVQMRLRLLNEDQM
KRSSLVILGFPLLVQVEQLNHHVDQILEPQAIVAVWQLGGSYARDHVVNLGVLPQDSGRIQGRPNHDLRIVDARIAELGQ
AREGVIEDFLQVEVQLLLRGI*

>ORF12795 (SEQ ID NO:101)
LPPNCQTATMAWGSRIWSTWWLSCSTCTSSGKPRMTSELRFIWSSLRSLRRICTRRSSRSSSGTFCASLRMLTITRLCST
RSSSSPRTPRTSSMNADSRPFGTSAASTTSWAITRMCAICRYSKRARPTLQRANSCSGI*

>ORF13755c (SEQ ID NO:211)
ATRTPALESSASDSVFCSAVTSQSSAIDRFFGIQLMRVWLDVTAPSTCAWQVLPRFLDFFLPLGSASSSSSSKGFRSSS
SSSSSPSTAPSAPAPCAAAFSASVLTVTLSRSVMTSVVSPTKAISSWNRCANAPPTSRMVRAEERRRLATNSIIAGRSRR
STLPSTNITASEKKRSQCVSFRYRCRNSRAGASDAPVLNSDRLRTSV*

>ORF13795c (SEQ ID NO:213)
CRRTHRHRNLGLVSYPNPSAGILSQRQRLLLRRDFPELCHRPLLRDPADEGLVGRDGTFHVCMAGAATLLGLLLATRFCF
VVVFKLEGLQVVVLVLVISVNGALSACALRGGLLGVRLDRHAVQIRDDQCCEPNEGDQLLEPMRERTTDFKDG*

>ORF14727c (SEQ ID NO:215)
QEVGELKDVLVAKYALGVVTAHAVVERPDAGHSLQASDISLLVGLVPVARGLPDTRAVILELFFKFGDPPADVVLQPNLD
VGLERLCNRPVKAVDGRDMNQRVIVDVRQDFIGGKVGIRDARDYLLPRPHAGAVLRDHPVQRLDEGGGLAGTCASTNHEG
LRRRYNACVDLAVGVGIWAINSSAHAVCPGSTMIATTSAVVGSIVATSVAMAASASSSWATLASSQAKPSAMYAGTFQP
LSGPLASTSSAKRVLSKFLPTTLSCNFSASSSGLLGARLSLRPTDRFASAWHQSAFSRPKASSSVRPQSCDVVAPTVTET
LVW*

>ORF13779 (SEQ ID NO:217)
RWVRRHHSSAAAHLRRPLVLRTRTGARLRQTGRSASSSSAHRAALKSWLRSYTIGWSARTSTRPALRWRYSQAGRSMAGR
FPRTSPRAWPGSKPKWPTSLRRMLPSPPRSRLLSRLQPMLSLSLLTRGRRHEQTN*

Fig. 4-6

>ORF14293c (SEQ ID NO:219)
GRWSCRNLRQHEPRRAAEASLQCMRGSRGRRRYLGYQFVCSCRLPRVNNDSDNIGCSRLNSRDLGGDGSIRLKLVGHFGF
EPGQALGDVRGNLPAIERPACEYLQRKAGLVEVLADHPIV*

>ORF14155 (SEQ ID NO:221)
PGADGMSRRIDSPDTDADREIHACIVATPPQPFVVRAGAGSGKTTSLIKALDWVISEHGASMRARKQIVACITYTDLATN
EILADVNDDPLVHVSTIHSFYWSIAKTFQADIKVWLQNDIRRRISELEEEFENYSSRVRQTTRDRNKADQERYVRSLEAV
AGVRTFNYGVGSDYAKGILGHEDILQLADFLLQNRPLFRRVVALSYPFVFIDESQDTFPGVVKSFKEVEAQMQGKFCLGF
FGDPMQSIFMRGAGDIQLEDHWRAITKPENFRCAKQILDVANAVRAQGDGMEQVRGLHERVDGNLKLVEGSARMFVLPNT
LNRTEALARVRAWSSATNNDEGWTTPDIAVKILVIVHRMAANRLGFGGIYSALNDKTSDAMKQGMQDGTGWPVRPFLSFA
LPIVAAVKAGNEFAAMSLLREFSPRLAPAALTGRRAADVLRELHAAASRLVAMLDEAGTTIGDIALHLCDTGLFEFDERY
ARVLGFVRDIADTAQEPEAADAVPAEGLSLDATMAKFFNCSAQELWPYERYVSEGSPYATQHGVKGAQFERVMVVMDEEE
SDYRTYNYERVFASAEARAADRARALDGDENTWSRTLRLLYVCCTRAQRGLVLAFFVADPATTLENVVASGILPRSAVFT
QEVLVGWP*

>ORF14360 (SEQ ID NO:223)
SRASRIPTLPPMKSWRTSTMTRWFMSRPSTAFTGLLQRRSRPTSRFGCRTTSAGGSPNLKKSSRITARVSGRPRATGTRP
TKSDMSEAWRLWPASGRSTTAWAVTTPRAYLATRTSFSSPTSCYKTARCSDGSWR*

>ORF15342c (SEQ ID NO:225)
EGSNGPTGAVLHPLLHGIRRLVVQRRVDAAEAKPVCGHAVHDDKNLDCDVWGCPTLVVVRRRAPRSDSCQSLGSVQRVRQ
DEHPGRPLHQLEVPIDPLVQPADLLHAIALRAHGIGDVKDLLGAAKVLRLRDGPPMILKLDVPCASHEDRLHRVAEKTKA
ELALHLGFHFLERLHYTRERVLTLIDKHERVAQRHDPSEQRAVL*

>ORF15260c (SEQ ID NO:227)
MPPKPSRFAAMRCTMTRILTAMSGVVQPSSLFVAELHARTLAKASVRFSVFGKTNIRADPSTSLRFPSTLSCSPRTCSMP
SPCARTALATSRICLAQRKFSGFVMARQ*

>ORF14991 (SEQ ID NO:229)
RRQCRARAGRWHGASPRAAREGRWEPQAGGGVGPDVRLAEHAEPNRGFGKSPSVELGDEQRRGLDNPRHRSQDSCHRAPH
GRKPAWLRRHLLGAERQDVGCHEARDAGRHRLARSTLPKFCATDRCSCEGRQ*

>ORF15590c (SEQ ID NO:231)
RSSNSKRPVSQRWRAMSPMVVPASSSMATSLDAAACSSRNTSAARRPVRAAGARRGLNSRSRLIAANSLPAFTAATIGSA
KLRKGRTGQPVPSCIPCFMASDVLSFSAE*

>ORF15675c (SEQ ID NO:233)
SFGRNCISSLGLLSGVSNIPDKPKNTRIALVELKKTRVTEMESYVTNGGPCLVQHGDKPRRSSVQLSQYIRGTSAGQSRR
RQARAEFPEQAHRRELIAGLHSCNDR*

>ORF16405 (SEQ ID NO:235)
IDSLRKCVGSLEKCCFACKEIIHVHAIRCRQCGESQGWRRFMSSPTSVVALVLSLLSIAATKPVERLFDAQRAELQISIT
GGDYKAAQLMLTNNGSKPATLVSFEITSKATTNTKTWFLVSNTDGEILEPGKTYKIRASTDESIPKIVEAERRTILKSQY
ALADNCELTAKYIEATGQKVVRVQPFMCDTPPEKGGLPPGKPGIPIWYLGQE*

Fig. 4-7

>ORF16925 (SEQ ID NO:237)
RPRGRRLCVCNRSCATHLLKRVACPLVNLAYPFGTLVKNDVFMPPWALTPIKQSCVRSSNTSLAQLNDCYVYGCCRYVIP
WPYAYEVNSESVQWTIFLLGVDCSGKVIYFRNTARVGPFLAASIYRPWYGSDALVLHFTK*

>ORF17793c (SEQ ID NO:239)
AKMIVIDKNLEHLVAQCAICEKTLFDEFSLKIQLGHTYYEPKSLPASASIVYGSHPAPSTFFLEPKEIQQNLVLKSGEQV
ITCSKHRYKIPLDYFGLVQTKGTLARLFVQVTCNDGQVEPGFDGYVTLEIVNMSPWTIEIPAVSDIAQLYLVKCSTSASE
PYHGRYMDAAKKGPTLAVFRK*

>ORF18548c (SEQ ID NO:241)
RTMAGWPRLAAQGRRTNLMSVLQIKGRTTKSHTDFDAASYSSNSLILTDAGDERIEEFSLELSVGEGWSDNYSGNDKNLW
RIVDGMTIRGHDSVVVEAAEEIKVPHNRYGIVLPTGSLFLSRGVLVASAKVEPAFDGKLKLRIFNTTNKNVCLTKGEKLG
SVIFFSTESTHTQSPIKRGSEISTLPITRRARLKKWFSLNPTIWVGWTLNLIGSSLVSSLIMYAVYYKVVLEHQSQPPQS
QQNAQPSPNEVKPK*

>ORF17875 (SEQ ID NO:243)
TAYIIREDTRELPIKFSVHPTHMVGLSENHFFNRARRVMGSVDISLPRLMGLWVCVDSVEKKITEPSFSPLVRQTFLLVV
LNILSLSLPSNAGSTFAEATSTPRERKRLPVGRTMPYRLCGTLISSAASTTTES*

Fig. 4-8

>ORF18479 (SEQ ID NO:245)
SVTHSSDLSFVLGLRDAATLPLSFIPADIPGYRLKDDVRKACTNLNFKRLAVIVGERERHRPYITWRQHTGTERYPASEQ
RASRKKKRRQIFRQIEFFHGARQISLARFHDEAVIRVCEHDLAGRGASRRFSQASTPYCQAREACESEVKSNAFRGGQLT
VGKVLD*

>ORF19027c (SEQ ID NO:247)
MIYSPHSLLKLVRDGKLIKHLAHRELTTPEGVGFDLRLAGLSRLTVGGGSLRESTRRTPASEVVLADPDDCFVMEPGKTY
LASTMEEFDLPEDLAALFFPRSTLFRSGITFSSSVLPPGYVGPMTFALTNNHSEAFEIQIGARFAHVIFQAVSGDIGRYK
GQWQGGRVSQPKDEGQI*

>ORF19305 (SEQ ID NO:249)
WPFSACRLFGMTGQVGCKRWSAPMQLGGHVRCNYAVEPGPVPPKQSIRPRWHIANKIPFPATVVLSLLPALIWRKSPLHE
SSWSLPCFNSFPGYPGSRPPPQQPKLPQGDSSFL*

>ORF19519 (SEQ ID NO:251)
SGGKARSMNRHGASHVSTPFLDIQEAVPHPNNQSCPRGIHPSSEQHGTARHASPPAATGEHLAARLAIQAAIRGDLPAAT
GQLCRAGPAAPCFGKSSPCPSRRDDRSRPGDRGLRTQGTADLPAPDRRSAGVTVSPG*

Fig. 4-9

>ORF19544 (SEQ ID NO:253)
IVMEPPMFQLLSWISRKPSPTPTTKAAPGGFILPLSSMELLGTPRRRQLLENIWQRASLSKQQFEEIYRRPLANYAELVQ
QLPASENHHHAHPGGMIDHGLEIVAYALKVRQTYLLPIGAAPESQSAQAEAWSAAAAYGALAHDIGKIVVDLQVELQDGS
TWHPWNGPINQPYRFKYVKSREYQLHGAASALLIHQLLPRTALDWLSRFPELWAQLIYLFAGQYEHAGILGEIIVKADQA
SVAQELGGNPDRALAAPKQSLQRQLADGLRFLVKDKFKLNQPSGPSDGWLTQDALWLVSKPAADQLRAYLLAQGIDGVPS
SNAPFFSMLQDQAVIQTNAEDKAIWTATVDNGAGWRNKFTLLKIAPALIWTDAAERPSPYSGSLVVEDGTASTEKPETTC
EIPNGPAEQQQAPETKMMLHQPAPSVAKPANETQAIAKPSTDDQEETDDLYALLGNINSPLEELDTSHDSPAASPTNTRG
EENLQQPLGTKEPTDCAPEAIEDVFMPSRSTDLGQGFVGWMKSGIAARRLFINDTKALVHTVDGTAMLVTPGIFKRYVQE
HPVLEKLAQAKETTGWKLVQRAFEKQGLHRKTSKNLNIWTIKVSGPRKTKELKAYLLQDPKLLFPEQPLDNPSLTVITDA
EGGVE*

>ORF20008 (SEQ ID NO:255)
ATGRQHLAPLERTDQPAIPLQVREVPRIPAPRRCLSTSHPPTATAHCTRLAQSLSRAVGSIDLPVRWAVRARRDPRRDHR
EGRPGLSCTGARRQSGSSSGCTEAVAAAAVGRRPSLLGEGQVQVEST*

>ORF20623c (SEQ ID NO:257)
RELVSPSSTVVYRGRPNGLVLGICLDDGLVLEHAEERRVRGGHPIDTLGQQVGSQLIGSRLAHQPECVLGQPSIRRAARL
IQLELVLHQEAKAVCQLPLQRLLRCSQSSIRIAS*

>ORF21210c (SEQ ID NO:259)
RLKIPGVTSMAVPSTVCTKALVSLMNRRRAAMPDFIQPTNPCPRSVLLLGINTSSIASGAQSVGSLVPSGCCRFSSPRVF
VGEAAGESWLVSSSSSGELILPRSAYKSSVSS*

>ORF21493c (SEQ ID NO:261)
AAAASFHTSFGIGDDREAWVVQRLLREQQFGILEQVGLELFRLARTRNLDGPDVQVFTGLPMKPLFFERALHQLPAGRLL
GLGQFFKHRMLLDIALENSWRDQHGGPVYGMHQSLGVVDEQATGRDARFHPTNESLSQISTSARHKYIFNCFRSAICWLL
GP*

>ORF21333 (SEQ ID NO:263)
TSGPSRFLVLARRKSSRPTCSRIPNCCSLSSLWTTQASRSSPMPKEVWNDAAAAHRGVHLRARSPGSQREDLPRRDQGAA
QALRSYGNRTGRGPPGCPGMATQGTGTRPVQAELEHVLESSADDLGLCHRA*

>ORF22074c (SEQ ID NO:265)
VRHKPLRYWHYELFVSLLCLAADEDQLIFPVDVALADAQQRIQPDAGEVEDLKRAKPEPGGRDPCAFAGAALCAVLHVEP
IAGEQDGFGGDGFACSPGGNDGGLSERVDLGVRHQLMLDGIAPDRPQMIRVRVPAPLGQALFQYLASPSQDSPVVHVLYG
CRRTEVLEQRLGRGAVDLRAGFPEIVREDVLLGELLRRHSTPPSASVMTVRLGLSRGCSGNSNLGSWSR*

>ORF21421 (SEQ ID NO:267)
AASGQPKPHGHHRCRRRCGMTPQQLTEEYIFAHDLREASAKIYRAATKALLKHFGPTATVQDVDHRAVLGWRRKVLEQGL
SKRSWNTYSNHLRTIWGYAIEHELVTHSQVNPFRKTTVIPPRRASKTVAAEAILLARNWLNMQDGAERCTGERARITPAW
FWLCTFEVFYFTGIRLNALLCIRKRDIDWENQLILIRGETEKTHKEFVVPITEGLVPHLSRLLQEADRAGFADDDQLFNV
NRFSPHYKSKVMNSDQVEAMYRKLTEKVGVRMTPHRFRHTLATDLMKAPERNIHLTKCLLNHSNIQTTMSYIEADYDHMR
AVLHARSLAQGALENVRKVDYSGSPQASAKPKPCGQPLARVSEAPPPEARTEPAEPREHTPGTGIQGGPTAWEADALPQP
PDTFEPSVLFTLMAQNLSNRAASASAAPAATSGSGGWGSAARSNLA*

Fig. 4-10

>ORF20008 (SEQ ID NO:255)
ATGRQHLAPLERTDQPAIPLQVREVPRIPAPRRCLSTSHPPTATAHCTRLAQSLSRAVGSIDLPVRWAVRARRDPRRDHR
EGRPGLSCTGARRQSGSSSGCTEAVAAAAVGRRPSLLGEGQVQVEST*

>ORF20623c (SEQ ID NO:257)
RELVSPSSTVVYRGRPNGLVLGICLDDGLVLEHAEERRVRGGHPIDTLGQQVGSQLIGSRLAHQPECVLGQPSIRRAARL
IQLELVLHQEAKAVCQLPLQRLLRCSQSSIRIAS*

>ORF21210c (SEQ ID NO:259)
RLKIPGVTSMAVPSTVCTKALVSLMNRRRAAMPDFIQPTNPCPRSVLLLGINTSSIASGAQSVGSLVPSGCCRFSSPRVF
VGEAAGESWLVSSSSSGELILPRSAYKSSVSS*

>ORF21493c (SEQ ID NO:261)
AAAASFHTSFGIGDDREAWVVQRLLREQQFGILEQVGLELFRLARTRNLDGPDVQVFTGLPMKPLFFERALHQLPAGRLL
GLGQFFKHRMLLDIALENSWRDQHGGPVYGMHQSLGVVDEQATGRDARFHPTNESLSQISTSARHKYIFNCFRSAICWLL
GP*

>ORF21333 (SEQ ID NO:263)
TSGPSRFLVLARRKSSRPTCSRIPNCCSLSSLWTTQASRSSPMPKEVWNDAAAAHRGVHLRARSPGSQREDLPRRDQGAA
QALRSYGNRTGRGPPGCPGMATQGTGTRPVQAELEHVLESSADDLGLCHRA*

>ORF22074c (SEQ ID NO:265)
VRHKPLRYWHYELFVSLLCLAADEDQLIFPVDVALADAQQRIQPDAGEVEDLKRAKPEPGGRDPCAFAGAALCAVLHVEP
IAGEQDGFGGDGFACSPGGNDGGLSERVDLGVRHQLMLDGIAPDRPQMIRVRVPAPLGQALFQYLASPSQDSPVVHVLYG
CRRTEVLEQRLGRGAVDLRAGFPEIVREDVLLGELLRRHSTPPSASVMTVRLGLSRGCSGNSNLGSWSR*

>ORF21421 (SEQ ID NO:267)
AASGQPKPHGHHRCRRRCGMTPQQLTEEYIFAHDLREASAKIYRAATKALLKHFGPTATVQDVDHRAVLGWRRKVLEQGL
SKRSWNTYSNHLRTIWGYAIEHELVTHSQVNPFRKTTVIPPRRASKTVAAEAILLARNWLNMQDGAERCTGERARITPAW
FWLCTFEVFYFTGIRLNALLCIRKRDIDWENQLILIRGETEKTHKEFVVPITEGLVPHLSRLLQEADRAGFADDDQLFNV
NRFSPHYKSKVMNSDQVEAMYRKLTEKVGVRMTPHRFRHTLATDLMKAPERNIHLTKCLLNHSNIQTTMSYIEADYDHMR
AVLHARSLAQGALENVRKVDYSGSPQASAKPKPCGQPLARVSEAPPPEARTEPAEPREHTPGTGIQGGPTAWEADALPQP
PDTFEPSVLFTLMAQNLSNRAASASAAPAATSGSGGWGSAARSNLA*

>ORF22608c (SEQ ID NO:269)
RICFPRGWTSLNACPWRVLPWFCRLCPGLRWRRFTHSSERLPAWLRFGRGLRGAAVIHLPDILQRALGQASSMQHGTHVI
VVGLDVAHRGLDIRVVEQALREVNVPLGCLHQVGGQGVPETVRGHPHPNLLGQLPVHGFDLVGVHHLALVVR*

>ORF22626 (SEQ ID NO:271)
HLRTKRAVHSDGSKLIEPCRLGIRGSRCNKRIRRMGICRPKQSRLAIPVLRAGYRTKGSRAFQQIVRPVGKIWNYRERLD
SSAGMLAEPAQFQGQYHSTLCNR*

Fig. 4-11

>ORF23228 (SEQ ID NO:273)
RDSNSRHPAPKAGALPDCAIPRLEFGSATWTRTRDPMINSHLLYRLSYRGTSFFQPWTLPVLLDSRLRGAPFYGCARACQ
PSDPKSFSSFSTSDKTALPLHAAALSRLPDAHEKAPPKRGFPCPPPKRSGEDDLVAFHLRRDTGTRREFAGQDQLRQRVL
DPALDGPLQRACAIDRVEADGNQLVQRLLAQFQAQLALGQALAQATELDLGDAGDLLASQRLEHHHFVDPVDEFRTEVRI
DRVHHCGTLRLAVAGQLLDLRRTEVGGHHHHGVAEVHRTPVTVGQASVLEHLEENVEYIRMGLLHLVQQHHRVGLAADRL
GQVAAFLEADVARRRADQAGHRVFLHELGHIYPHQRLLGIEEELGQRLAQLGLAHPGRAEEEERAARPVRIGEAGARTAH
GVGHGDYRLVLADHSPMQLLLHAQQLLALALEHLRHRDTGPLGNHFGDFLVGHLVAQQLVLGLAVLVDHLQAAFQVRDGL
VLDARHALEVALAPRRLHLLLGLLDLLLDLRRALHLGLLGLPDLLEVGVFALELDDILLQLGQALPGGFVVFLLQRLALD
LQLDQATVETIQFLRLGVDLHADAAGGLVDQVDGLVRQLPIGDVAVRQLGRGDDRAVGDAHPVVHFIAFLEATEDGDGVF
LARFVHQHLLEAALQRGILLDVLAILVEGSSTDAVQLAARQSRLEHVAGVHGTFRLAGADHGVQFVDEQDDPAFLLAQFV
EDRLQAFLELAAELGTGDQRPHVQGQQALVLEAVRHFAVDDALGQALDDGGLADAGFADQHRVVLGPPLQDLDGPADLVV
ATDHRVELAFLGALGHVDGVLVQRLARLLDVRVVHRFAATQVGHGILQRLARHALAEQQLAEPGVLVHRGQQYQLAGDEL
VALLLGQAVSLVEQACEILGQVHVAGRALDLRQRVEFFVEAAAQGGDIEADLHQQGLDRTALLLEQGGKQVHRLDGRMVM
ANGQGLGVGERQLQLAGQTVYSHGSSFLL*

>ORF23367 (SEQ ID NO:275)
AIAERLSSNPGRFRCCWIRVSEARHFTDARGHVNPLIQKVFLLFPRATKRPFHCMRQRSRAYRTPMKKPRRSGAFPVRPR
RGQAKTISSPSTFAEILAPGANLPARISCASGFSIQRWMARFSGRAP*

>ORF25103c (SEQ ID NO:277)
SAPRGEHHRRRDHRRGQAVAPLHHRSATAGQGHRPDRRGRQPHPHGDRLQAGGTGSSRPSPDPAEDRARGAEEGRRRSHQ
EAPGQAGGGYRQARARIRRPRGDLEVREGRGAGLGADPAEDRAGQAGDGGGAAQGRPREHGAHPVPDHPGPGTQPADGRP
ARQDREPVAAQQGDRRGNRRSGFQVDRYPGVEDARGRAREAAAHGAGAASASDRPGRGGSRRVQRRAPFARRPRRSEPAE
RLVPLPRPDRGGQDRVVQGAGRVPLRYRGGAGADRYVRVHGETLGGPPDRRASGLRRLRGRRLPDRGDPPQALLGGAAGR
GGEGPSGCIQHSPPGARGRTPDRQSRAYGGLPQHRGGDDLQPRFGADPGAGRRPRGATCRSDGRGQCALPSGIHQPDRRS
GGVRAAGSRADRRHRRDPARSPAQAPGRARAEPGTEPGGAGQADCRRLRPGLWRTPAEAGHPALDREPAGATDPGRQIRA
GCQYLGEGGRRRDRLRLTSSGADRESPASAGLFHGRPVGARALPHAVEGPFCRSWKKKKNFLDQRVDMPARIRKMARL*

>ORF23556 (SEQ ID NO:279)
KSPAEAGLSLSAPEEVRRRRSRRLPPSPRYWHPARICRPGSVAPAGSRSSAGWPASAGVRHRPGRSRRQSACPAPPGSVP
GSARARPGACAGDRAGSRRCRRSAREPAARTPPLRRSG*

>ORF26191c (SEQ ID NO:281)
KEGRPMRIDRLTSKLQLALSDAQSLAVGHDHPAIEPVHLLSALLEQQGGSIKPLLMQVGFDIAALRSGLNKELDALPKIQ
SPTGDVNLSQDLARLLNQADRLAQQKGDQFISSELVLLAAMDENTRLGKLLLGQGVSRKALENAVANLRGGEAVNDPNVE
ESRQALDKYTVDMTKRAEEGKLDPVIGRDDEIRRTIQVLQRRTKNNPVLIGEPGVGKTAIVEGLAQRIINGEVPDGLKDK
RLLALDMGALIAGAKFRGEFEERLKAVLNELGKQEGRVILFIDELHTMVGAGKAEGAMDAGNMLKPALARGELHCVGATT
LDEYRQYIEKDAALERRFQKVLVDEPSEEDTIAILRGLKERYEVHHGVSITDGAIIAAAKLSHRYITDRQLPDKAIDLID
EAASRIRMEIDSKPEELDRLDRRLIQLKIEREALKKEDDEATRKRLAKLEEDIVKLEREYADLEEIWKSEKAEVQGSAQI
QQKIEQAKQEMEAARRKGDLESMARIQYQTIPDLERSLQMVDQHGKTENQLLRNKVTDEEIAEVVSKWTGIPVSKMLEGE
REKLLRMEQELHRRVIGQDEAVVAVSNAVRRSRAGLADPNRPSGSFLFLGPTGVGKTELCKALAEFLFDTEEALVRIDMS
EFMEKHSVARLIGAPPGYVGFEEGGYLTEAIRRKPYSVVLLDEVEKAHPDVFNILLQVLEDGRLTDSHGRTVDFRNTVVV
MTSNLGSAQIQELAGDREAQRAAVMDAVNAHFRPEFINRIDEVVVFEPLAREQIAGIAEIQLGRLRKRLAERELSLELSQ
EALDKLIAVGFDPVYGARPLKRAIQRWIENPLAQLILAGKFAPGASISAKVEGDEIVFA*

Fig. 4-12

>ORF23751 (SEQ ID NO:283)
TGSKPTAISLSSASWLSSRLSSRSARRLRRRPSWISAMPAICSRASGSNTTTSSIRLMNSGRKCALTASITAARCASRSP
ASSWICAEPRLEVITTTVLRKSTVRP*

>ORF24222 (SEQ ID NO:285)
PGGAPIRRATECFSMNSDISIRTSASSVSKRNSASALHNSVLPTPVGPRKRNEPLGRFGSARPARERRTALDTATTASSW
PITRRCSSCSMRSSFSRSPSSIFDTGIPVHLETTSAISSSVTLLRSNWFSVLPCWSTICRLRSRSGMVWYWMRAMLSRSP
LRRAASISCLACSIFCWICAEPCTSAFSDFQISSRSAYSRSSLTISSSSLARRFLVASSSSFFSASRSIFSWIRRRSRRS
SSSGLESISMRMRLAASSIRSMALSGSCRSVM*

>ORF24368 (SEQ ID NO:287)
TRTYLSAPAPPRYRRGTRPAPCTTRSCPPRSGRGRGTSRSAGSDRRGRRANGARRWTRRLPPRPGRSLADAAPAPCAAAS
RARPRASSTPGYRSTWKPLRRFPRRSPCCAATGSRSCRAGRPSAGCVPGPGWSGTGCAPCSRGRPCAAPPPSPAWPARSS
AGSAPSPAPRPSRTSRSPRGRRIRARA*

>ORF24888c (SEQ ID NO:289)
RRKTTKPPGSAWPSWRRISSSSSANTPTSRRSGSPRRPRCRARRRSSRRSSRPSRRWRRRGARATSRAWRASSTRPSRTW
NAACRWSTSTARPRTSCCATR*

>ORF25398c (SEQ ID NO:291)
RRSSTNWASRKAGSSCSSTNCTPWSAPARRKVPWTPATCSSRLWRAASCTASVLLPSTSIASTSRRMPRWSAASRRCWWT
NRARKTPSPSSVASRNAMKCTTG*

>ORF25892c (SEQ ID NO:293)
PPGPAEGRPVHLQRAGIAGRDGREHQARQAAARPGRVAQGAGECRGQPAWRRSGERPERRGVAPGAGQVHRRHDQARRGR
QARPGDRSRRRDPPDHPGPAAADQEQPGADRRTRRRQDRHRRGPGPAHHQRRSAGRPQGQAPAGPGHGGADRRCQVPRRV
RGTPEGGPQRTGQAGRPGHPVHRRTAHHGRRQGGRCHGRRQHAQAGSGARRAALRRCYYPRRVSPVHREGCRAGAPLPE
GAGGRTERGRHHRHPPWPQGTL*

>ORF25110 (SEQ ID NO:295)
RSLRPRRMAMVSSSLGSSTSTFWKRRSSAASFSMYWRYSSRVVAPTQCSSPRARAGLSMLPASMAPSALPAPTMVCSSSM
NRMTRPSCLPSSLRTAFRRSSNSPRNLAPAISAPMSRASRRLSLRPSGTSPLMMRWARPSTMAVLPTPGSPISTGLFLVR
RCRTWMVRRISSSRPITGSSLPSSARLVMSTVYLSSAWRDSSTFGSFTASPPRRLATAFSSALRDTPWPSSSLPSLVFSS
IAASNTSSLEMNWSPFCWARRSAWLSRRARSWDRFTSPVGLWIFGSASSSLLRPLRRAAISKPTCISRGLIEPPCCSSRA
ESRCTGSMAGWSWPTARDWASESASCSLLVKRSIRMGRPSFYRAGRNDGCP*

>ORF25510 (SEQ ID NO:297)
CAGPGPRRWRSCRRRVRRSAPGCSWSAAAGPGWSGGSRRRDRSPGRACLPRRAWSCRRCTCPAPGATPRRSGRSPLRRHA
GWPRHSPAPCATRPGRAAACRAWCSRPSRPAIPARWR*

>ORF26762c (SEQ ID NO:299)
PPTACRRCSATARAPGWPRPMPAGAGWRRACWRRRWTAWACPATNCWSGWGRRSARRPSRSAARSAMHSSLRTPRRARLS
YLAPIRAASWPTSTDSRGSAWAPMASPPCMAAASAPSAIPRASIPTAARRVPAVLPAWSGSRTRPAQVIRRQLTDVTVRS
LEPRKIALIY*

>ORF26257 (SEQ ID NO:301)
IRAIFRGSSDRTVTSVSCRRITCAGLVLEPDQAGKTAGTRRAAVGIEARGIAEGAEAAAMHGGDAMGAQADPRESVDVGH
EAARIGARYESRARLGVRSDECIADLAADLEGLRADRRPQPDQQFVAGHAQAVHRRLQHARRQPAPAGMGRGHPGARAVA
EQRRQAVGGHDRTGDARHRAPAGVGPEHRFGSASTTSLRAPIPTSSAGIPDARSGVGGFIPRRADRRRRGRQGSDCRRVP
G*

Fig. 4-13

>ORF26844c (SEQ ID NO:303)
RGGGRPEPVLRADASWSAMPGVACTIMTADCLPALFCDRSGTRVAAAHAGWRGLAAGVLEATVDSLGVPGDELLVWLGPA
IGPQAFEVGGEVRDAFVAAHAEARSAFVPSANPGRFMADIYRLARIRLGAHGVTAVHGGGFCTFSDTARFYSYRRSSRTG
RFASLVWLQD*

>ORF26486 (SEQ ID NO:305)
MSAMKRPGLALGTKAERASACAATNASRTSPPTSKACGPIAGPSQTSSSSPGTPRLSTVASSTPAASPRQPAWAAATRVP
ERSQNNAGRQSAVMIVQATPGIALQLASALSTGSGRPPPRHSVHLFQPARPAFQTLGQASAVLFHGARIVVDVGAKVQTV
EGCLADPATARGHAGPHTGRRRPVGGQPGVQPTNASRSWRNRLSSQRNSSGSGDSHFMRTPVAG*

>ORF26857c (SEQ ID NO:307)
VHGVTWWRPTRTGAQGRRQLERDAGRRLYDHDRRLPAGVVLRPLGHPGGRGPCRLARAGGGRAGGDGGQPGRARRRTAGL
AGAGDRPAGLRGRRRGPRCIRRCARRGALGFRT*

>ORF27314c (SEQ ID NO:309)
SGNRRCRKNSSGCSACCARIARRSSVERLADPRLAGAGPCAGLRDHAQWRGQPGTLRQSEPWRPRLRRSARRGIKPPTPD
RASGMPAELVGIGARSDVVEADPNRCSGPTPAGARCRASPVRS*

>ORF27730c (SEQ ID NO:311)
QARRPGGPSGCRPSGRHPAECLALPCPGHRQCAARRDRPPPGQGHDRPDGSGQDAGGPHQAGGATAGTVGQPHLRGDRDR
RDHLRRHHRCADRTAWRAAAEDGGGRRRQGGGQPLPRAGTLPCAHPYPGQAGDRAYPPDPRAHEPYWLSPGRRSGLRWAL
QDSPGGQPDPGPDSSRIPPAGAARALPRTGSPGHRRAHEVGIAAAGRIPLAAQPVAPGSRGVRRLNAWLTPDWPAPARVR
ACVTTRSGGVSQAPFDSLNLGAHVYDDPRAVE*

>ORF26983 (SEQ ID NO:313)
PRHCAWSRRPAHGPAPASRGSARRSTDERLAILAQQAEQPEEFFRQRRFPLHAHAGGRVIQFEEARVQRLPGEFAKSLDQ
GLAGHRGNPEAPTVDRIADQGIANMAHVHADLVGTPGLQLDPGMGVRTEAFQHAVMADRHLAGVDHRHLLPLHAMPSDRR
IDGAAGGDHADHDRLVDAADRPCLQLRHQLGVGLQRLGHYHQAGRVLVQAVDDPGARHIGDVRDMVEQGIQQGAVLMAGS
RMDHQAGGLVNHQDVLVLVDDFQLDVLCEPLALGFLLGLQDQLRAAVDDVARAQHGAVDGQATVLDPAGQTGAGVFGKKL
GGDLVETLATQLERHLGRALNHIGHE*

>ORF28068c (SEQ ID NO:315)
PQRVADSKSRAEHRLLLMSDMIQRAAEVPFELGGQRLDQIAAQLFPEHSRSRLAGWIKDGRLTVDGAVLRPRDIVHSGAQ
LVLEAEQEAQGEWLAQDIELEIVYEDEHILVIDKPAGLVVHPAAGHQDGTLLNALLYHVPDIANVPRAGIVHRLDKDTTG
LMVVAKTLEAHTKLVAQLQARSVSRIYEAIVIGVITSGGTIDAPIGRHGVQRQKMAVVDAGKVAVSHYRVLERFRAHTHT
RVKLETGRTHQIRVHMSHIGYPLVGDPVYGGRFRIPPVASQTLVQTLREFPRQALHARFLELDHPATGVRMKWESPLPEE
FLWLLSLLRQDREAFVG*

>ORF27522 (SEQ ID NO:317)
PTVPAVAPPAWCGPPASWPLPSGRSCPCPGGGRSRRAAHWRCPGHGRARHSAGCRPDGRQPDGPPGRRACQSPGCARPRR
RFPARCPVRATRPGLPARPPGPVARRCGRCRAGAARRRRSGDRP*

Fig. 4-14

>ORF28033c (SEQ ID NO:319)
ASSPTHVRYDSTRGRGAVRAGWPASRPDRRPAFSRTLPLPSGRLDQGRSPDRRRRRAAPARHRPQRRATGPGGRAGSPGR
VARTGHRAGNRLRGRAHPGD*

>ORF29701c (SEQ ID NO:321)
SSSSLEISRTSTRPMVRRYRWYRRRMRCPCSSLSRSRSARTVALVLAQVRLAAIPALFVGEGVGLRHVDAAMGAADHRRC
ARLVLRTLLLARSGTGKATPEPERDGDQGDPEQEAEKAHGDLGGWRKLQFSQAAGSIPDGKVQAVRRLALGEAWRRAKRR
EACASLRCFVRSVEETEGHVAPPGATGVLVVIALRLLVVGAVILVFRLQFGGDLPLGILVLLDHVLGGLGFHVRRRLAAF
DQAQGGLGQPGAGVGLAFAGDELAILEAGVIRIVQLEGFQAGAGQVVETQATVGFDHDRQAIADGRGFLEVLHHVATAVG
GGDIGLALQVVVADVHFVGRQQVAQVHHARLGVRGVAAVGEAAGELGELVEGVAGGARVALGHVQRQEARQQAAVLVEGG
QAFEVVGVVDVGVLRMQADEAFGGGAGGFGLHVLVVGVDQLELGLLGVAAEGIARFEGFQLGDGAVVALVVEVVLRLLVQ
LALAQVLVDSLLVRGAGCGEGEDGDQQQVFHLHGGLRPWDGRLGLNRLL*

>ORF28118 (SEQ ID NO:323)
QTVEAKPTVPGTQAAMQVKHLLLIAILALTAACSSNKETVDENLSESQLYQQAQDDLNNKSYNSAVTKLKALESRYPFGR
YAEQAQLELIYANYKNMEPEAARAAAERFIRLHPQHPNVDYAYYLKGLSSFDQDRGLLARFLPLDMTKRDPGAARDSFNE
FAQLTSRFPNSRYAPDAKARMVYLRNLLAAYEVHVGHYYLKRQAYVAAANRGRYVVENFQETPAVGDGLAIMVEAYRRLG
LDDLASTSLETLKLNYPDNASLKDGEFVARESEADTRSWLAKATLGLIEGGEPPPHMETQAAKDVIKQYEDAEREIPAEL
KPENQDHSADDEKPESDDDEDSGRSWWSYMTFGLFD*

>ORF28129 (SEQ ID NO:325)
GQADRPRDASRHASETPAADRHPRPHRSLLLEQGDCRREPEREPAVPAGAGRPQQQELQQRRHQAESPRIALSLRPLRRA
GPARADLRQLQEHGARSRPRRRRTLHPPASAAPQRRLRLLPQRPVLLRPGPRPAGALPAAGHDQARPGRRPRLLQRVRPA
HQPLPQQPLRPGRQGAHGVPAQPAGGLRSARRPLLPEAPGLCRRRQPRSLRGGELPGNPGRRRWPGDHGRSLPSPGSRRP
GQHQPGNPQAELSG*

>ORF29709c (SEQ ID NO:327)
GPDLPVRWRSAGPVPGRWSGGTGGTDGGCVAPAPRSAVAVQRARSPWSWRRCAWLQYQRCSWARALACGTWTPQWAQRTI
GDALGSSCGRCCWRGVGRVKRRQSQNAMAIRAIQNRRRKRPMVISEAGESCSLAKPPARSQTGRSRLCGVWRWERHGGGQ
KEGRPAPPFGVSCDQSKRPKVM*

>ORF29189 (SEQ ID NO:329)
SHETPKGGAGLPSFCPPPCLSQRQTPHSLDLPVWDRAGGLAKLQLSPASEITMGLFRLLFWIALIAIAFWLWRRFTRPTP
RQQQRPQDEPSASPMVRCAHCGVHVPQANALAHEQRWYCSQAHLRQDQGDRAR*

>ORF29382 (SEQ ID NO:331)
SPSRSGSGVALPVPLRASSNVRRTSRAHRRWSAAPIAASTCRRPTPSPTNNAGIAARRTCARTRATVRAERLRLSEEQGQ
RILRLYHLYRLTIGLVLVLLISSELEDQVLKLVHPELFHVGSWCYLVFNILVALFLPPSRQLLPIFILALTDVLMLCGLF
YAGGGVPSGIGSLLVVAVAIANILLRGRIGLVIAAAASLGLLYLTFFLSLSSPDATNHYVQAGGLGTLCFAAALVIQALV
RRQEQTETLAEERAETVANLEELNALILQRMRTGILVVDSRQAILLANQAALGLLRQDDVQGASLGRHSPMLHCMKQWR
LNPSLRPPTLKVVPDGPTVQPSFISLNREDDQHVLIFLEDISQIAQQAQQMKLAGLGRLTAGIAHEIRNPLGAISHAAQL
LQESEELDAPDRRLTQIIQDQSKRMNLVIENVLQLSRRRQAEPQQLDLKEWLQRFVDEYPGRLRNDSQLHLQLGAGDIQT
RMDPHQLNQVLSNLVQNGLRYSAQAHGRGQVWLSLARDPESDLPVLEVIDDGPGVPADKLNNLFEPFFTTESKGTGLGLY
LSRELCESNQARIDYRNREEGGGCFRITFAHPRKLS*

>ORF30590c (SEQ ID NO:333)
LLQQLGGVADRAQRVADLMGDAGGQAAKTGQLHLLRLLGDLRNVFEEDQHVLVVFAVEADKAGLHRRAIRHHLERRRTEA
GIQAPLLHAVHQHRAVAAEAGALHVVLPEQAEGGLVGEEDGLTAIDHEDAGAHALQDQCVEFLQVGDRLGAFFGQRFGLL
LAPHQSLDHQRGGEAQGAEAAGLDVVVGGVRTAQAEEEGQVEQAEAGRRRDDQADAPAQQDVGNGHRHHQQAADAAGYAA
TCVEQAAKHQHVGEREDEDRQQLPRRRQEQRDQDVEDQVAPTADMEQFRVDELEDLIFQFAGDQQDQYQADGQAVQVVQT
EDALPLLLAQP*

Fig. 4-15

>ORF29729 (SEQ ID NO:335)
TVPCRQLVLPGLQHPGRAVPAAVAAIAADLHPRAHRRADALRPVLRRWRRTQRHRQPAGGGGGHCQHPAARAHRPGHRGG
GQPRPALPDLLPQPEQSGRHQPLRPGRRPRHPVLRRRAGDPGSGAAPGADRNAGRRTRRDGRQPGGTQRIDPAAHAHRHP
RGR*

>ORF30221 (SEQ ID NO:337)
PSGHPPRQPGRPRPAQAGRRAGRQPRPPQPDADALHEAMAPESQPPSADAQGGAGWPDGATQLYQPQPRRRPARADLPRR
HFADRPAGAADEAGRSWPPDRRHRP*

>ORF30736c (SEQ ID NO:339)
SHSFRSSCCGSAWRRRESCRTFSMTRFIRFDWSWMICVRRRSGASSSSDSCSSWAAWLIAPSGLRISWAMPAVRRPRPAS
FICCACWAICEMSSRKISTCWSSSRLRLIKLGCTVGPSGTTLSVGGRRLGFRRHCFMQCISIGLWRPRLAPCTSSCLSRP
RAAWLARRMA*

>ORF30539 (SEQ ID NO:341)
DPQPAGRDQPRRPTAAGVRGTGCPGPTPDADHPGPVEADEPGHRERPAALPSPPGRTAAARPEGVASAVRRRIPRQAAQR
QPTAPAARCRRHPDPHGPTPVEPGAEQPGAERSSLQRPGARARPGLAEPRARPGERPAGAGSHRRRSRRTGGQTEQPVRT
LLYYRKQRHRPGPLSLPRTLREQPGTDRLPQSRGRRRLLPHHLRPPAQTQLTEAARMSRQKALIVDDEPDIRELLEITLG
RMKLDTRSARNVKEAASCWPASRSTCASPTCACRTAAASIWSSTSSSAIHRPRWP*

>ORF31247c (SEQ ID NO:343)
FPAVRGYPVHRRRSGLFVGSCVRLPSAEFARVGEGDAEAAAAFLAIAVVDPCLVALAEFAGEIEAQAGAFAFCSKEGFEQ
VVQFVRRYAGTVVDDFQHRQVALRVAREAQPDLAAPVRLGAVAKTVLHQVAQHLVQLVWVHAGLDVAGTELQVQLAVVAQ
PAGVFVDEPLKPLLQVELLRFGLAATGELQDVLDDQVHPLRLVLDDLRQASVRGIQFL*

>ORF30963c (SEQ ID NO:345)
LPAPAGRSPGRARGSARPGRARAPGRCSEDRSAPGCSAPGSTGVGPCGSGCRRHRAAGAVGCRCAACRGIRRRTAEATPS
GRAAAVRPGGDGRAAGRSR*

>ORF31539c (SEQ ID NO:347)
GGCHQLPQATEVDRFGEEVEGTGLERLDRGVQAAVRGDHGHRGLWMALLDVLDQIEAAAVRQAHVGEAQVERLAGQQLAA
SLTLRALRVSSFMRPRVISSSSRISGSSSTIRAFCRLMRAASVS*

>ORF31222 (SEQ ID NO:349)
TGYPRTAGNHSRPHEAGHPQRPQRQGSRELLAREPFDLCLTDMRLPDGSGLDLVQYIQQRHPQTPVAMITAYGSLDTAIQ
ALKAGAFDFLTKPVDLGRLRELVATALRLRNPEAEEAPVDNRLLGESPPMRALRNQIGKLARSQAPVYISGESGSGKELV
ARLIHEQGPRIERPFVPVNCGAIPSELMESEFFGHKKGSFTGAIEDKQGLFQAASGGTLFLDEVADLPMAMQVKLLRAIQ
EKAVRAVGGQQEVAVARAHPLRHPQGPRRRSRRRALPPGPLLPPQRHRAARTPLRERREDIPLLAERILKRLAGDTGLPA
ARLTGDAQEKLKNYRFPGNVRELENMLERAYTLCEDDQIQPHDLRLADAPGASQEGAASLSEIDNLEDYLEDIERKLIMQ
ALEETRWNRTAAAQRLGLTFRSMRYRLKKLGID*

>ORF31266 (SEQ ID NO:351)
SWTPAAPATSRKPRVAGPRAVRPVPHRHAPAGRQRPRSGPVHPAAPSTDPGGHDHRVRQPGHRDPGAQGRCLRLPHQTGR
PRSLAGAGGNRPTLAQPGSRGSAGGQPPARRVAADARPAQPDRQAGAQPGAGLHQWRVRQRQGTGGAPDPRAGATYRAAV
RAGELRRDSLRADGKRVLRPQERQLHWRYRRQAGPVPGRQRWHPVPRRSRRPADGHAGQTAPGDPGKGRARGRRPAGGRR
RTCASSAPPTRTSPPKSAPGASARTSTTASTSSSCAYTAARTPRGHPAARRTHPQAPGRRHRPAGRQADRRRTGEAEELP
LPGQRPRAGKHAGARLYPVRRRPDPASRPAPGRCAGCQPGRRREPERNRQPRGLPGRHRAQADHAGTRGDPLEPHRRGPA
PGPDVPLDALPPEKAGHRLKVKRPVRRQAFWFSLLRGDQPGRRGPGR*

Fig. 4-16

>ORF31661c (SEQ ID NO:353)
TGAWLRASLPIWLRRARIGGDSPSRRLSTGASSASGLRKRRAVATSSRKRPRSTGLVRKSKAPALSAWIAVSRLPYAVIM
ATGVCGWRCWMYWTRSRPLPSGRRMSVRHRSNGSRASNSRLP*

>ORF32061c (SEQ ID NO:355)
RSWRKRPAPTSAARSLWVAQRMRTCDGDLLLAADRAHGLFLDRPEQFDLHGHRQVGDFVEEQGATAGGLEQALLVFDSAS
EAAFLVAEELAFHQLGGNRAAVHRHERPLDTWPLLVDQARHQFLAAAGLATDVDRRLAARQLADLVAQGAHRRRLAEQAV
VHRRFLGFRVAQA*

>ORF32072c (SEQ ID NO:357)
GGSRGPGGSARRRLRRRGPCGWRRGCARATATSCWPPTARTAFSWIARSSLTCMAIGRSATSSRNRVPPLAAWNRPCLSS
IAPVKLPFLWPKNSLSISSEGIAPQFTGTNGRSIRGPCSWIRRATSSLPLPDSPLM*

>ORF31784 (SEQ ID NO:359)
WKASSSATRKAASLALSKTSRACSRPPAVAPCSSTKSPTCRWPCRSNCSGRSRKRPCARSAASRRSPSHVRILCATHKDL
AAEVGAGRFRQDLYYRLNVIELRVHRCANAARTSRCSPNASSSAWPATPACRPPG*

>ORF32568c (SEQ ID NO:361)
GAKTKRPVFGQAFSLSVDAQLFQAVAHRAERQAQALGRGGAVPAGLLECLHDQLALDVFQVVLEVVDFAQARGAFLAGTR
RIGQAQVVRLDLVVFAQGIGALQHVFQLADVAREAVVLQLLLCVAGQPGGRQAGVAGQALEDAFGEQRDVLAAFAQRCTR
SSMTLRR*

>ORF33157c (SEQ ID NO:363)
TDGGARLVARRRSSGRRGDLAWRDPWRQGAAGGRRLERRVVEAAWPGTARGTGERSDDPLQVRGGFPAAHGAGQGALRDS
AARRPHPDRQHLGTFGLRQDADRRGAGKPQGVCGRTVAGTGGHAAGGPLGRVAPGLSRRHPLYRSGAWLRRALAEYRALP
QRAGPGTGVVPSAGGSHERAGTDHRPGPLRPGWSPLRSENQKACLRTGLFTFSRCPAFSGGSASSGTSGPGAGPRRCGSS
GSPRVPA*

>ORF32530 (SEQ ID NO:365)
KGLSEDRPFGFRSSEATSRGVGGRVDDRFPPAHEIRQQTARRRCQDQPVAVVPGIQPEPVEARHRTDIGDAFGRARAQPC
PVGHRLHVRQFRQQFCRRRPEAFQRLVGRRLVEARMFQGAADQDVAVAPRNRVAPLGQHHARQEIRRALVEDHLTFHRYH
GQFQAKRLQQLAAPGACRQQHLVATDLATRGRHADHSIAVAQPAAHLRLFMQLEIGELLQGCPQ*

>ORF33705c (SEQ ID NO:367)
VIFLCSWQIGRSPVVSRDVVVVGAGVIGLLTARELALAGLRVTLVERGESGREASWAGGGIVSPLYPWRYSPAVTALAHW
SQDFYPALGQRLLDETGLDPEVHTVGLYWLDLDDQTEALQWARNHTRPLKEVPIEEAYAAVPGLGAGFQRAVYMSGVANV
RNPRLARSLRASLQQFANLELHEQTEVRGWLRDGDRVVGVATSRGEIRGDKVLLAAGAWSGELLKPLGLELPVVPVKGQM
ILYKCAADFLPRMVLAKGRYAIPRRDGHILIGSTLEHSGFDKTPTDEALESLRASAAELLPELADMQPVAHWAGLRPGSP
EGIPYIGPVPGFDGLWLNTGHYRNGLVLAPASCRLLADLMSGREPIIDPAPYAPAGRL*

>ORF32832 (SEQ ID NO:369)
GFPAPRRSASCRSPNVPRCCRSGCGRRAAESRSAPWPAPCAAGNPPRTCRGSSDLSPVPRAVPGQAASTTRRSRRLPPAA
PCRHGSRHARSPRRPLDRRRATSRAPPSVHATRDWRIVAGMPAMSAPGEDCAHWPRPTCRPPAGSLRPARAPPRRPPRSA
LPSTAGCGCVPTAVPRSGRPGPASTGQRYGPRDRARSRRANAAPGPGRSPATSAPGRSPPGCSATDRAARRSRLPPRMPH
AHSRPAPPGSPAVRRAPAPGRSTGR*

Fig. 4-17

>ORF33547c (SEQ ID NO:371)
GILGGRRDRLAALSVALQPGGDRPGALVAGLLPGPGAAFARRDRARSRGPYRWPVLAGPGRPDRGTAVGTQPHPAVEGSA
DRGGLRGGARAGRRLPAGGLHVGRGQCAQSSPGALIAGIPATIRQSRVA*

>ORF33205 (SEQ ID NO:373)
ARQARIAHIGHARHVDRPLEACAQPGHRRVGLLDRHFLQRPGVVACPLQCLGLVVQVQPVQANGMDLGIEPGLVEQTLPQ
GRVEVLRPVRQGGHRRAVAPRIERRDDPASRPGCLTPTLAPLHQGHPQSGERQLPGGQQADDASAYHYYISTHHRAPTDL
PGTEKYHSKGSDADELPASTNSVESSPGEKPIIPAEVFIP*

>ORF33512 (SEQ ID NO:375)
SGETIPPPAQDASRPLSPRSTRVTRSPASASSRAVNRPMTPAPTTTTSLLTTGLLPICQEQRNITQRDQMLTNCLLQRTQ
SNLVPVKSPSYPQRYSSHEIEWFEFGGTIDSPIDPCDRRDNCAAHPPRQNEAGH*

>ORF33771 (SEQ ID NO:377)
KAHHTRRGIHPMKSSGLNLVELSIVLSILAIGVTIALPTLPDRMKRDISRDIGDSLTSHVMAARASSIQNGVIIEVCGSG
DGSTCSEEWHLGWFSRNDRSQQILARHENTSRTDIHWRGFDKRLRYLPNGTSPTGNGRFFECKDDRIEWQLVLNRQGRLR
VAGKSENKKLSYLCSRR*

>ORF34385c (SEQ ID NO:379)
WRAHCPCSRDSRSGEWDDWQTVCETVLSPPGAQVRELFIFALSRHPEAALPIEHQLPLDAIVLTFEETPVTCRAGAIRQV
AQSLVEAPPMNIGATRIFMPGQYLLAPVVTAEPAEMPFLAAGTAVTATAHLDDHAVLYAASPRSHHMTSQAVTNITANVP
LHSVGEGGQRNCHAYRKDR*

>ORF33988 (SEQ ID NO:381)
SSRCAVAVTAVPAARNGISAGSAVTTGANRYWPGMKIRVAPIFIGGASTSDCATCLMAPALQVTGVSSNVRTIASSGNWC
SIGKAASGWRERAKIKSSLTCAPGGERTVSHTVCQSSHSPLRLSLLQGQCALH*

>ORF34274 (SEQ ID NO:383)
KALLPVLQAVRELFHIPFASHPTLRSGCLCYRDNALSTRQDYLALFLVEYCMRSICRSAGFSLIELMMVLVLVAIFASIA
VPSFNALIERNRIQTASEELYSLLQYARSEAVNRHANVSIRATQNNDWAKGLEIISGATTVQKHQGFQQVSLSASSATAE
LTFNATGTLSNQAANIDIKVCFAGDKSTGRLLTVQPSGRVILYPSSKQPDSCN*

>ORF34726c (SEQ ID NO:385)
RDLLETLVLLHGGRAADDFQAFCPVIVLRRPDAHIGMTVYSFAASVLKQAVEFLAGSLDSVALDQGVETGYGNAGEYGDQ
NQHHQLDQGKAGAATNRAHAVLHKEKGQIILPSGERIVPVAETAGAESGMTGKRYVKQFSHRLEHR*

>ORF34916 (SEQ ID NO:387)
GKPMSRETGFSMIEVLVALVLISIGVLGMVAMQGRTIQYTQESVQRNAAAMLASDLMEIMRADPDAVLNLRAQLREDSVY
YKAKGSDFPAAPARCAPLPADAKERLGCWAQQASKDLPGASALLNSQFYICRSPTPGTCDNTKGSAIEIQVAWRAMDGAC
FNASDSTLCTYSVRSEL*

>ORF35464c (SEQ ID NO:389)
RACLFSQFGADAVGAQGGVRGVETRSIHGSPGNLDFDGRAFGVVAGTRGWAATNVELAIQECGGSRQVFRGLLGPAAETF
LSICWQWRAARWGCGKVAALGLVVDRVFA*

>ORF35289 (SEQ ID NO:391)
IANSTFVAAQPRVPATTPKARPSKSRLPGEPWMERVSTPLTPPCAPTASAPNCENKHALQQNAERPIDGRTARGTRYKQL
PDPGDQPDLHRQQTQLSFPARPGRQPGK*

Fig. 4-18

>ORF35410 (SEQ ID NO:393)
LHLVHLQRPLRIVRTSMLFSKMQKGLSMVELLVALAISSFLILGISQIYIDNKRNYLFQQGQAGNQENSRFVLMLLQQQL
DKTAYRRLHDDNMENAFKSATFNGCRAFVAGETIAAATALKAGEYGVCLRYQPAYKGEHDCLGNEITGVPEKPFTNTPPV
VVRLVYLPSAGTLSCSRPDIAQSKSGELVSGLTDFRLEAGVGPADRSERKVSSFVALQDVAGRPIRALRFSILAGSDNTS
LRTGDDSQARDRWIVLYPESKSAIEAADKGQIYQIARGNQTIRNLMP*

>ORF35907c (SEQ ID NO:395)
VDQANDDRGSICEGLFRNSGNFITEAIMLPFVGGLIAQADTVLTRLEGSCRSDSLASHKCTTAIECRGFESILHVVVVKA
TIGCLIQLLLQQHKNEAAIFLVAGLALLEKIVAFVVDVDLADPQDQEAAYSECHEQFYHR*

>ORF35534 (SEQ ID NO:397)
SWGSARSTSTTNATIFSSKARPATRKIAASFLCCCSNNWIRQPIVAFTTTTWRMLSNPRHSMAVVHLWLARLSLRQLPSR
RVSTVSACAINPPTKGSMIASVMKLPEFRKSPSQILPLSSFAWSTYRAPVP*

>ORF35930 (SEQ ID NO:399)
VAVVPISPSRNRENWSVVSQTSAWKRGSGQQIVANAKYPASSHYRMSPVVLSEHCASQSWQAATIQACAQEMIARHAIAG
SSFIPRAKAPSRPQTKARFTK*

>ORF36246 (SEQ ID NO:401)
PNHQESHAMTLRHTSRQQGSTLLISLVILLMITLLAVSNMREVSLESRITGNLIEQKRLRNAGEAGLREGERRFFNTIKP
PEVGSGCADSNVKRPCILNLSALSVPRDDVHNNPVAALNGKTDNANSRVWMPYRGSDLNNPTQIDKDRAVTWQTITVPAG
EQNNEAENPEYGNMMRGVGTFYYETNSRALNKAGGETVLQAVHARLYTN*

>ORF26640c (SEQ ID NO:403)
GIQTRELALSVLPFRAATGLLCTSSRGTERALRFSMQGRLTLLSAHPLPTSGGLMVLKKRRSPSRSPASPALRRRFCSMR
LPVIRLSSDTSRMLETARSVIINKITSEINNVDPCCREVWRRVMA*

>ORF36769 (SEQ ID NO:405)
CAGSARSTTKPTAAPSTRRAERLFYRPFMHACIPTDWSQRMIHQITRAGKSLLAAGCTLSILFASDSYAATALNVSQQPL
FLTQGVAPNLLFTLDDSGSMAWAYVPDGISGNSGRAGRSSDYNALYYNPDYAYQVPKKLTLSGDQIIVSDYPVPRFTAAW
QDGYAQGSTTNLSNNYRPQWGTGWLGCIDSSCNTGRAYYYTYKVSASCPAQPVSSSNSCYTYNALPTSQESNFAIWYSYY
RNRILATKTAANLAFYSLPENVRLTWGALNTCSIGANSRSCQNNALLQFNKQHKINFFNWLANSPASGGTPLHAALDRAG
RFLQTNGTAYTTEDGKTYSCRASYHIMMTDGIWNGRNVTPGNLDNQNQTFPDSTLYRPQPPYADSNASSLADLAFKYWTT
DLRPSIDNDLKPFMAYKSGDDSKDYWDPRNNPATWQHMVNFTVGLGLSYSLTLNSAPTWTGSTFGNYEELMAGSKAWPSV
DNDAAPGNVYDLWHAAINSRGDFFSAESPDSLVQAFNKILTRISERNTSSSKPAMTSALQDDGTGDKLIRYSYQSSFASD
KNWAGDLIRYKVESTSTGSTKTQEWSAGALLDNRAPATRNIYIASNSGTNRLKPFTWSNIEGSQLATWLNRNPDKDNQAD
TKGAQRVDFIRGQQNMDGFRQRQAVLGDIVHSSPAVVGPAQYLTYLANPIEPSGDYGTFKTEADQRSPRVYVGSNDGMLH
GFNIKTGVEEFAFIPTAVFEKLNKLTGISYQGGAHQYFVDATPVVSDAFFDGAWHTVLIGTLGAGGRGLFALDVTKPDDV
KLLWEYDSSTDSDLGYTFSKPTVARLHSGQWAVVTGNGYGSDNDKAALLLIDLKKGTLIKKLEVQSERGIANGLSTPRLA
DNNSDGIADYAYAGDLQGNIWRFDLIGNTRNDDPDTNTSINPFKPGDVDPSAFRVSFSGAPLFRARADNNTRQPITAPPT
LVRHPSRKGYIVIVGTGKYFEDDDAQADTSRAMTLYGIWDRQTKGESANSTPTIDRNALTAQTMTTEANSTFGSVNRNIR
LISQNPVKWYKDGATGTANSDVASYGWRLNLEVNSSKKGEMMIEDMFAAGQVLLLQTLTPNDDPCDSGSTSWTYGLNPYT
GGRTSFTVFDLKRAGIVDSGSDYNGSVVSAFQQDGLGGLAITQNEQRQSEACTGDECIIFNPSDKSNGRQTWRVVEEK*

>ORF37932c (SEQ ID NO:407)
AGIAVGIRGLWPIEGAIRKGLVLVVEIAGGDVPTVPDTVGHHDVIAGPAGICLSVFGGISCAVGLQEASGSVKSRMQRST
AAGRAVRQPIEEIDFVLLVELEQGIVLAASAVGADATGVQGPPSETHVFRQAVKGQVGSGLCGQDAVAIVGVPYRKVAFL
TGRKSIVGITGVGAAHRLCRAASAYLISIVISSPGIAAAIDATKPAGSPLRAIVIAQVGGGALGVAILPGCCEAWHWIVG
NDDLIA*

Fig. 4-19

>ORF38640c (SEQ ID NO:409)
LTSLNIAPCERLKAVGSAIAGDVNITGSGSSVVQQCAGAPFLGFGRTGGSRLHLVTYKVARPVLVTGKAGLVAVADQLVA
GSVILQRGSHCWFGGGGVALGNPCQDLIESLNQRVR*

>ORF39309c (SEQ ID NO:411)
SCLVIIASIAVAGNYCPLSAVQSGYGRFGEGVTKVRVGTAIVFPKQLDIVRLGYIECEQAATSSTKRSDQNSVPSSIEKG
IADDRCSVDEILVGTALVADAGKLVKLFEYCCRDESELFHAGFDVETMQHAIVGSNINSRAALVCLCLECAVVAAGFDGV
GQISEVLGRSDHGWRRVHDVP*

>ORF38768 (SEQ ID NO:413)
GTSCTRLQPWSDRPNTSLIWPTPSNPAATTAHSRQRQTSAALEFMLDPTMACCMVSTSKPAWKSSLSSLQQYSKSLTSLP
ASATRAVPTNISSTLHRSSAMPFSMELGTLF*

>ORF40047c (SEQ ID NO:415)
KHLAGSEHIFDHHFAFLAAIDLQIQSPAIASHIRVRGTGCSVFVPLHRVLANKPNIPVHATECGVRLCCHGLGCEGVAVD
GWGTVCAFALGLAIPDTIERHGSAGIGLSVIVLEVFSCTYDDDVALTARMAYQGRRSRDGLTSIVVGASTEKRGAAERYS
ESRRIYISGLEGIDRGICVWVVVAGIADQIEAPDISLQIASIGVVSNAIAVVISQARRR*

>ORF40560c (SEQ ID NO:417)
PASPVVGHGWASDMSAHRLLPDRRQDEHPRPRPHSRTYSWHSRQRLGKPELELQELWREDVRGSCSFLLDDPPGLSSVTL
VAGVEDDALITSASLGLTLFVLGNGQAT*

>ORF40238 (SEQ ID NO:419)
VAWPLPRTNSVNPRLALVMSASSSTPATRVTDDKPGGSSRRNEHEPLTSSRHSSCSSSSGLPNLCLECHEYVRECGRGRG
CSSCRRSGSSRWADISLAQPCPTTGLAGHILGTSGTDSVFLRQTHQRPARNRVVLHYQAGPSRSLRIGAATMKSNRGFTL
IELMIVVVIIAILAGIAYPSYDEYVKRGNRTEGQALLSEAAATQERYFSQNNTYITTQADIGKLHMRNTSGTTVKSSTGK
YSLTVDTVANDGGYRLIANQAFNDLDCGNLTLTANGEKGRTGSKKSVAECWR*

>ORF40329 (SEQ ID NO:421)
RTTNLAGRRGEMNMNPLRLLATALAALALACPTFALSATNTFENVGVVEDVHPAAGLVVVDGQTYRLPNRVQQQDSPVIF
LVRQGQTVSFSGKLTSDLPEIESFYIIKQAPLVPFGSEQQQ*

Fig. 4-20

>ORF40709c (SEQ ID NO:423)
SLCSTSLLLLRSEGNERGLLDNVERLDFWQVAGEFAGERHCLSLTYQEYDRRVLLLDTVGQAICLPIDYYQTGGRMNILD
HAHILERIRGTQGKGWASQS*

>ORF40507 (SEQ ID NO:425)
SMGRHIACPTVSNNRTRRSYSWYVRDRQCLSPANSPATCQKSSRSTLSSRPLSFPSDRSSNNEVEQRLHSHRVDDRRSNH
RYSCWYRLPQLRRIREARESHRRTGITQRSSRYSRALFFTEQYLYHYPSRHRQAAYAQHIGHHSEVLHRQIQPYRRYGSQ
RRRLSPYR*

>ORF41275c (SEQ ID NO:427)
VGGVGRAGTGGTGGEHYLLDAQGTAGQGFVIGIFAHLKKPGLCRALPFSCLGALAPAFCNALLASSPAFLAVGGQGQVAT
IKIVECLVSDKAITSVVGYRIDGKAVFACGGLHCGARCVAHMQLADVGLGSDISIVL*

>ORF42234c (SEQ ID NO:429)
STSSRPEPSVAAPFPSGEGGSKVHSSNHRVAHETAMQIKLANPRGFCAGVDRAIEIVNRALDVFGPPIYVRHEVVHNKFV
VDNLRQRGAIFVEELDQVPDNVIVIFSAHGVSQAVRKEAEGRGLKVFDATCPLVTKVHMEVVRYSRDGHECVLIGHEGHP
EVEGTMGQYDASNGGAIYLVEDEADVAALEVRKPEALHYVTQTTLSMDDTSKVIDALRAKFPQIQGPRKNDICYATQNRQ
DAVKELADQCDMVLVVGSPNSSNSNRLRELAERMGTPAYLIDGAEDMQRGWFDGVRRIGITAGASAPEVLVRGVIAQLRE
WGASEEQELEGREENITFSMPKELRVKAL*

Fig. 4-21

>ORF41764c (SEQ ID NO:431)
RPPRGGRHHGPVRCQQRRCHLPGGGRGRRRRAGGAQARSPALRDPDHPVDGRHLEGHRCPARQVPADPGAAQERHLLCHP
EPPGCREGTGRPVRHGPGGGQPQQFQLQPPARTRRAHGHAGLPDRRRRGHATRLVRRCASHRNHRRRLRAGSAGARSDRP
AT*

>ORF41284 (SEQ ID NO:433)
LGDHSAHQHFRRGGACGDSDATHTVEPAALHVLGAVDQVGRRAHALGEFAQAVGVGTVGAAHHQDHVALVGQFLHGILAV
LGGIADVVLARPLDLRELGAQGIDDLRGVVHRQGGLGHVVQGFGLAHLQRGDVGLVLHQVDGTAVAGIVLAHGAFHLGVA
FMPDQHAFVAVAAVAHHFHVHLGHQRAGRVENLQAAPLGFLADRLGNAVGAEDDDDVVRHLIEFLDEDGAALAQVVHDEL
VVHHLVTHVDRRAEDIEGTVDDLDGAIHAGAEAAGIGEFDLHGGLVGDAVIGRMNLATALPAWEGRSDRRFRPAGRR

>ORF41598 (SEQ ID NO:435)
PSRCRPSTGWSGSRSAGLRACAPPARRRRPRPPPGRWHRRCWHRTGPWCLPPRGGLHARSARIRGRRGCSAPLPCAPWSP
AGRSRRKPSGRAPRLPCGPPGKRRGR*

>ORF42172c (SEQ ID NO:437)
QGSFVQSPRRPRDRHANQTRQSPRLLRRRGSRHRDRQPCPRCLRPADLRASRGGAQQVRRGQPAPARRHLRRGTRSGAGQ
RHRHLQRPRRFPGGPQGSRGARPEGFRRDLPAGDQGAHGSGALQPRRPRMRADRA*

>ORF42233c (SEQ ID NO:152)
RRPAGLNRRSLRPSQAGRAVARFIRPITASPTRPPCKSNSPIPAASAPAWIAPSRSSTVPSMSSARRSTCVTRWCTTSSS
WTTCASAAPSSSRNSIRCRTTSSSSSAPTAFPRRSARKPRGAA*

Fig. 4-22

33A9 (SEQ ID NO:102)

```
CAAAGCATAAGACCAAGATGGCACATTGCCAACAAAATACCCTTCCCCGCTACCGTTGTTTTATCGTTGTTGCCAGCCCT
GATCTGGCGGAAAAGCCCGCTCCATGAATCGTCATGGAGCCTCCCATGTTTCAACTCCTTTCCTGGATATCCAGGAAGCC
GTCCCCCACCCCAACAACCAAAGCTGCCCCAGGGGGATTCATCCTTCCTCTGAGCAGCATGGAACTGCTCGGCACGCCTC
GCCGCCGGCAGCTACTGGAGAACATCTGGCAGCGCGCCTCGCTATCCAAGCAGCAATTCGAGGAGATCTACCGGCGGCCA
CTGGCCAACTATGCCGAGCTGGTCCAGCAGCTCCCTGCTTCGGAAAATCATCACCATGCCCATCCAGGCGGGATGATCGA
TCACGGCCTGGAGATCGTGGCCTACGCACTCAAGGTACGGCAGACCTACCTGCTCCCGATCGGCGCAGCGCCGGAGTCAC
AGTCAGCCCAGGCTGAAGCCTGGTCGGCCGCCGCGGCGTATGGCGCCCTGGCTCATGACATAGGCAAGATCGTCGTCGAC
CTGCAGGTTGAGCTACAGGACGGCAGCACCTGGCACCCTTGGAACGGACCGATCAACCAGCCATACCGCTTCAAGTACGT
GAAGTCCCGCGAATACCAGCTCCACGGCGCTGCCTCAGCACTTCTCATCCACCAACTGCTACCGCGCACTGCACTCGATT
GGCTCAGTCGCTTTCCAGAGCTGTGGGCTCAATTGATCTACCTGTTCGCTGGGCAGTACGAGCACGCCGGGATCCTCGGC
GAGATCATCGTGAAGGCAGACCAGGCCTCAGTTGCACAGGAGCTAGGAGGCAATCCGGATCGAGCTCTGGCTGCACCGAA
GCAGTCGCTGCAGCGGCAGTTGGCAGACGGCCTTCGCTTCTTGGTGAAGGACAAGTTCAAGTTGAATCAACCTAGCGGCC
CGTCTGATGGATGGCTGACCCAGGACGCACTCTGGCTGGTGAGCAAGCCTGCTGCCGATCAACTGAGAGCCTACCTGCTG
GCCCAGGGTATCGATGGGGTGCCCTCCTCTAACGCGCCGTTCTTCAGCATGCTCCAGGACCAAGCCGTCATCCAGACAAA
TGCCGAGGACAAGGCCATTTGGACGGCCACGGTAGACAACGGTGCTGGATGGAGAAACAAGTTCACGCTACTCAAGATTG
CTCCAGCCTTGATCTGGACAGATGCTGCCGAGCGCCCCTCACCCTACAGCGGATCACTGGTCGTTGAAGATGGAACCGCC
TCAACGGAAAAGCCGGAAACGACCTGTGAAATTCCCAACGGGCCGGCTGAACAGCAGCAAGCACCAGAAACGAAGATGAT
GCTCCATCAACCTGCGCCGAGCGTTGCGAAACCGGCAAACGAGACGCAGGCGATTGCGAAACCCTCAACTGATGATCAAG
AAGAAACAGACGATTTGTATGCACTTCTTGGTAATATCAATTCGCCACTAGAAGAGCTAGACACTAGCCACGACTCGCCG
GCTGCCTCTCCTACGAACACACGCGGGGAGGAGAACCTACAGCAGCCACTAGGGACCAAGGAGCCAACAGATTGCGCTCC
TGAAGCAATTGAAGATGTATTTATGCCTAGCAGAAGTACTGATCTGGGACAGGGATTCGTTGGTTGGATGAAATCTGGCA
TCGCGGCCCGTCGCCTGTTCATCAACGACACCAAGGCTTTGGTGCATACCGTAGACGGGACCGCCATGCTGGTCACGCCA
GGAATTTTCAAGCGCTATGTCCAAGAGCATCCGGTGCTTGAAAAACTGGCCCAAGCCAAGGAGACGACCGGCTGGAAGCT
GGTGCAGCGCGCGTTCGAAAAACAGGGGCTTCATCGGAAGACCAGTAAAAACCTGAACATCTGGACCATCAAGGTTTCTG
GTCCTCGCAAGACGAAAGAGCTCAAGGCCTACCTGCTCCAGGATCCCAAATTGCTGTTCCCTGAGCAGCCTCTGGACAAC
CCAAGCCTCACGGTCATCACCGATGCCGAAGGAGGTGTGGAATGACGCCGCAGCAGCTCACCGAGGAGTACATCTTCGCG
CACGATCTCCGGGAAGCCAGC
```

Fig. 5

33A9 SEQ ID NO:103

```
  1 MNRHGASHVS TPFLDIQEAV PHPNNQSCPR GIHPSSEQHG TARHASPPAA
 51 TGEHLAARLA IQAAIRGDLP AATGQLCGVG PAxPCFGKSS PCPSRRDDRS
101 RPGDRGYALK VRQTYLLPIG AAPESQSAQA EAWSAAAAYG ALAHDIGKIV
151 VDLQVELQDG STWHPWNGPI NQPYRFKYVK SREYQLHGAA SALFIHQLLP
201 RTALDWLSRF PELWAQLIYL FAGQYEHAGI LGEIIVKADQ ASVAQELGGN
251 PDRALAAPKQ SLQRQLADGL RFLVKDKFKL NQPSGPSDGW LTQDALWLVS
301 KPAADQLRAY LLAQGIDGVP SSNAPFFSML QDQAVIQTNA EDKAIWTATV
351 DNGAGWRNKF TLLKIAPALI WTDAAERPSP YSGSLVVEDG TASTEKPETT
401 CEIPNGPAEQ QQAPETKMML HQPAPSVAKP ANETQAIAKP STDDQEETDD
451 LYALLGNINS PLEELDTSHD SPAASPTNTR GEENLQQPLG TKEPTDCAPE
501 AIEDVFMPSR STDLGQGFVG WMKSGIAARR LFINDTKALV HTVDGTAMLV
551 TPGIFKRYVQ EHPVLEKLAQ AKETTGWKLV QRAFEKQGLH RKTSKNLNIW
601 TIKVSGPRKT KELKAYLLQD PKLLFPEQPL DNPSLTVITD AE*
```

Fig. 6A

33A9--ORF1 SEQ ID NO: 189

ATGGAGCCTCCCATGTTTCAACTCCTTTCCTGGATATCCAGGAAGCCGTCCCCCACCCCAACAACCAAAGCTGCCCCAGG
GGGATTCATCCTTCCTCTGAGCAGCATGGAACTGCTCGGCACGCCTCGCCGCCGGCAGCTACTGGAGAACATCTGGCAGC
GCGCCTCGCTATCCAAGCAGCAATTCGAGGAGATCTACCGGCGGCCACTGGCCAACTATGCCGAGCTGGTCCAGCAGCTC
CCTGCTTCGGAAAATCATCACCATGCCCATCCAGGCGGGATGATCGATCACGGCCTGGAGATCGTGGCCTACGCACTCAA
GGTACGGCAGACCTACCTGCTCCCGATCGGCGCAGCGCCGGAGTCACAGTCAGCCCAGGCTGAAGCCTGGTCGGCCGCCG
CGGCGTATGGCGCCCTGGCTCATGACATAGGCAAGATCGTCGTCGACCTGCAGGTTGAGCTACAGGACGGCAGCACCTGG
CACCCTTGGAACGGACCGATCAACCAGCCATACCGCTTCAAGTACGTGAAGTCCCGCGAATACCAGCTCCACGGCGCTGC
CTCAGCACTTCTCATCCACCAACTGCTACCGCGCACTGCACTCGATTGGCTCAGTCGCTTTCCAGAGCTGTGGGCTCAAT
TGATCTACCTGTTCGCTGGGCAGTACGAGCACGCCGGGATCCTCGGCGAGATCATCGTGAAGGCAGACCAGGCCTCAGTT
GCACAGGAGCTAGGAGGCAATCCGGATCGAGCTCTGGCTGCACCGAAGCAGTCGCTGCAGCGGCAGTTGGCAGACGGCCT
TCGCTTCTTGGTGAAGGACAAGTTCAAGTTGAATCAACCTAGCGGCCCGTCTGATGGATGGCTGACCCAGGACGCACTCT
GGCTGGTGAGCAAGCCTGCTGCCGATCAACTGAGAGCCTACCTGCTGGCCCAGGGTATCGATGGGGTGCCCTCCTCTAAC
GCGCCGTTCTTCAGCATGCTCCAGGACCAAGCCGTCATCCAGACAAATGCCGAGGACAAGGCCATTTGGACGGCCACGGT
AGACAACGGTGCTGGATGGAGAAACAAGTTCACGCTACTCAAGATTGCTCCAGCCTTGATCTGGACAGATGCTGCCGAGC
GCCCCTCACCCTACAGCGGATCACTGGTCGTTGAAGATGGAACCGCCTCAACGGAAAAGCCGGAAACGACCTGTGAAATT
CCCAACGGGCCGGCTGAACAGCAGCAAGCACCAGAAACGAAGATGATGCTCCATCAACCTGCGCCGAGCGTTGCGAAACC
GGCAAACGAGACGCAGGCGATTGCGAAACCCTCAACTGATGATCAAGAAGAAACAGACGATTTGTATGCACTTCTTGGTA
ATATCAATTCGCCACTAGAAGAGCTAGACACTAGCCACGACTCGCCGGCTGCCTCTCCTACGAACACACGCGGGGAGGAG
AACCTACAGCAGCCACTAGGGACCAAGGAGCCAACAGATTGCGCTCCTGAAGCAATTGAAGATGTATTTATGCCTAGCAG
AAGTACTGATCTGGGACAGGGATTCGTTGGTTGGATGAAATCTGGCATCGCGGCCCGTCGCCTGTTCATCAACGACACCA
AGGCTTTGGTGCATACCGTAGACGGGACCGCCATGCTGGTCACGCCAGGAATTTTCAAGCGCTATGTCCAAGAGCATCCG
GTGCTTGAAAAACTGGCCCAAGCCAAGGAGACGACCGGCTGGAAGCTGGTGCAGCGCGCGTTCGAAAAACAGGGGCTTCA
TCGGAAGACCAGTAAAAACCTGAACATCTGGACCATCAAGGTTTCTGGTCCTCGCAAGACGAAAGAGCTCAAGGCCTACC
TGCTCCAGGATCCCAAATTGCTGTTCCCTGAGCAGCCTCTGGACAACCCAAGCCTCACGGTCATCACCGATGCCGAAGGA
GGTGTGGAATGA

Fig. 6B

33A9--ORF2  SEQ ID NO:190

```
ATGTTTCAACTCCTTTCCTGGATATCCAGGAAGCCGTCCCCCACCCCAACAACCAAAGCTGCCCCAGGGGGATTCATCCT
TCCTCTGAGCAGCATGGAACTGCTCGGCACGCCTCGCCGCCGGCAGCTACTGGAGAACATCTGGCAGCGCGCCTCGCTAT
CCAAGCAGCAATTCGAGGAGATCTACCGGCGGCCACTGGCCAACTATGCCGAGCTGGTCCAGCAGCTCCCTGCTTCGGAA
AATCATCACCATGCCCATCCAGGCGGGATGATCGATCACGGCCTGGAGATCGTGGCCTACGCACTCAAGGTACGGCAGAC
CTACCTGCTCCCGATCGGCGCAGCGCCGGAGTCACAGTCAGCCCAGGCTGAAGCCTGGTCGGCCGCCGCGGCGTATGGCG
CCCTGGCTCATGACATAGGCAAGATCGTCGTCGACCTGCAGGTTGAGCTACAGGACGGCAGCACCTGGCACCCTTGGAAC
GGACCGATCAACCAGCCATACCGCTTCAAGTACGTGAAGTCCCGCGAATACCAGCTCCACGGCGCTGCCTCAGCACTTCT
CATCCACCAACTGCTACCGCGCACTGCACTCGATTGGCTCAGTCGCTTTCCAGAGCTGTGGGCTCAATTGATCTACCTGT
TCGCTGGGCAGTACGAGCACGCCGGGATCCTCGGCGAGATCATCGTGAAGGCAGACCAGGCCTCAGTTGCACAGGAGCTA
GGAGGCAATCCGGATCGAGCTCTGGCTGCACCGAAGCAGTCGCTGCAGCGGCAGTTGGCAGACGGCCTTCGCTTCTTGGT
GAAGGACAAGTTCAAGTTGAATCAACCTAGCGGCCCGTCTGATGGATGGCTGACCCAGGACGCACTCTGGCTGGTGAGCA
AGCCTGCTGCCGATCAACTGAGAGCCTACCTGCTGGCCCAGGGTATCGATGGGGTGCCCTCCTCTAACGCGCCGTTCTTC
AGCATGCTCCAGGACCAAGCCGTCATCCAGACAAATGCCGAGGACAAGGCCATTTGGACGGCCACGGTAGACAACGGTGC
TGGATGGAGAAACAAGTTCACGCTACTCAAGATTGCTCCAGCCTTGATCTGGACAGATGCTGCCGAGCGCCCCTCACCCT
ACAGCGGATCACTGGTCGTTGAAGATGGAACCGCCTCAACGGAAAAGCCGGAAACGACCTGTGAAATTCCCAACGGGCCG
GCTGAACAGCAGCAAGCACCAGAAACGAAGATGATGCTCCATCAACCTGCGCCGAGCGTTGCGAAACCGGCAAACGAGAC
GCAGGCGATTGCGAAACCCTCAACTGATGATCAAGAAGAAACAGACGATTTGTATGCACTTCTTGGTAATATCAATTCGC
CACTAGAAGAGCTAGACACTAGCCACGACTCGCCGGCTGCCTCTCCTACGAACACACGCGGGGAGGAGAACCTACAGCAG
CCACTAGGGACCAAGGAGCCAACAGATTGCGCTCCTGAAGCAATTGAAGATGTATTTATGCCTAGCAGAAGTACTGATCT
GGGACAGGGATTCGTTGGTTGGATGAAATCTGGCATCGCGGCCCGTCGCCTGTTCATCAACGACACCAAGGCTTTGGTGC
ATACCGTAGACGGGACCGCCATGCTGGTCACGCCAGGAATTTTCAAGCGCTATGTCCAAGAGCATCCGGTGCTTGAAAAA
CTGGCCCAAGCCAAGGAGACGACCGGCTGGAAGCTGGTGCAGCGCGCGTTCGAAAAACAGGGGCTTCATCGGAAGACCAG
TAAAAACCTGAACATCTGGACCATCAAGGTTTCTGGTCCTCGCAAGACGAAAGAGCTCAAGGCCTACCTGCTCCAGGATC
CCAAATTGCTGTTCCCTGAGCAGCCTCTGGACAACCCAAGCCTCACGGTCATCACCGATGCCGAAGGAGGTGTGGAATGA
```

Fig. 6C

ORF 3— 33A9 SEQ ID NO:191

ATGGAACTGCTCGGCACGCCTCGCCGCCGGCAGCTACTGGAGAACATCTGGCAGCGCGCCTCGCTATCCAAGCAGCAATT
CGAGGAGATCTACCGGCGGCCACTGGCCAACTATGCCGAGCTGGTCCAGCAGCTCCCTGCTTCGGAAAATCATCACCATG
CCCATCCAGGCGGGATGATCGATCACGGCCTGGAGATCGTGGCCTACGCACTCAAGGTACGGCAGACCTACCTGCTCCCG
ATCGGCGCAGCGCCGGAGTCACAGTCAGCCCAGGCTGAAGCCTGGTCGGCCGCCGCGGCGTATGGCGCCCTGGCTCATGA
CATAGGCAAGATCGTCGTCGACCTGCAGGTTGAGCTACAGGACGGCAGCACCTGGCACCCTTGGAACGGACCGATCAACC
AGCCATACCGCTTCAAGTACGTGAAGTCCCGCGAATACCAGCTCCACGGCGCTGCCTCAGCACTTCTCATCCACCAACTG
CTACCGCGCACTGCACTCGATTGGCTCAGTCGCTTTCCAGAGCTGTGGGCTCAATTGATCTACCTGTTCGCTGGGCAGTA
CGAGCACGCCGGGATCCTCGGCGAGATCATCGTGAAGGCAGACCAGGCCTCAGTTGCACAGGAGCTAGGAGGCAATCCGG
ATCGAGCTCTGGCTGCACCGAAGCAGTCGCTGCAGCGGCAGTTGGCAGACGGCCTTCGCTTCTTGGTGAAGGACAAGTTC
AAGTTGAATCAACCTAGCGGCCCGTCTGATGGATGGCTGACCCAGGACGCACTCTGGCTGGTGAGCAAGCCTGCTGCCGA
TCAACTGAGAGCCTACCTGCTGGCCCAGGGTATCGATGGGGTGCCCTCCTCTAACGCGCCGTTCTTCAGCATGCTCCAGG
ACCAAGCCGTCATCCAGACAAATGCCGAGGACAAGGCCATTTGGACGGCCACGGTAGACAACGGTGCTGGATGGAGAAAC
AAGTTCACGCTACTCAAGATTGCTCCAGCCTTGATCTGGACAGATGCTGCCGAGCGCCCCTCACCCTACAGCGGATCACT
GGTCGTTGAAGATGGAACCGCCTCAACGGAAAAGCCGGAAACGACCTGTGAAATTCCCAACGGGCCGGCTGAACAGCAGC
AAGCACCAGAAACGAAGATGATGCTCCATCAACCTGCGCCGAGCGTTGCGAAACCGGCAAACGAGACGCAGGCGATTGCG
AAACCCTCAACTGATGATCAAGAAGAAACAGACGATTTGTATGCACTTCTTGGTAATATCAATTCGCCACTAGAAGAGCT
AGACACTAGCCACGACTCGCCGGCTGCCTCTCCTACGAACACACGCGGGGAGGAGAACCTACAGCAGCCACTAGGGACCA
AGGAGCCAACAGATTGCGCTCCTGAAGCAATTGAAGATGTATTTATGCCTAGCAGAAGTACTGATCTGGGACAGGGATTC
GTTGGTTGGATGAAATCTGGCATCGCGGCCCGTCGCCTGTTCATCAACGACACCAAGGCTTTGGTGCATACCGTAGACGG
GACCGCCATGCTGGTCACGCCAGGAATTTTCAAGCGCTATGTCCAAGAGCATCCGGTGCTTGAAAAACTGGCCCAAGCCA
AGGAGACGACCGGCTGGAAGCTGGTGCAGCGCGCGTTCGAAAAACAGGGGCTTCATCGGAAGACCAGTAAAAACCTGAAC
ATCTGGACCATCAAGGTTTCTGGTCCTCGCAAGACGAAAGAGCTCAAGGCCTACCTGCTCCAGGATCCCAAATTGCTGTT
CCCTGAGCAGCCTCTGGACAACCCAAGCCTCACGGTCATCACCGATGCCGAAGGAGGTGTGGAATGA

Fig. 6D

ORF 4--33A9 SEQ ID NO:192

ATGATCGATCACGGCCTGGAGATCGTGGCCTACGCACTCAAGGTACGGCAGACCTACCTGCTCCCGATCGGCGCAGCGCC
GGAGTCACAGTCAGCCCAGGCTGAAGCCTGGTCGGCCGCCGCGGCGTATGGCGCCCTGGCTCATGACATAGGCAAGATCG
TCGTCGACCTGCAGGTTGAGCTACAGGACGGCAGCACCTGGCACCCTTGGAACGGACCGATCAACCAGCCATACCGCTTC
AAGTACGTGAAGTCCCGCGAATACCAGCTCCACGGCGCTGCCTCAGCACTTCTCATCCACCAACTGCTACCGCGCACTGC
ACTCGATTGGCTCAGTCGCTTTCCAGAGCTGTGGGCTCAATTGATCTACCTGTTCGCTGGGCAGTACGAGCACGCCGGGA
TCCTCGGCGAGATCATCGTGAAGGCAGACCAGGCCTCAGTTGCACAGGAGCTAGGAGGCAATCCGGATCGAGCTCTGGCT
GCACCGAAGCAGTCGCTGCAGCGGCAGTTGGCAGACGGCCTTCGCTTCTTGGTGAAGGACAAGTTCAAGTTGAATCAACC
TAGCGGCCCGTCTGATGGATGGCTGACCCAGGACGCACTCTGGCTGGTGAGCAAGCCTGCTGCCGATCAACTGAGAGCCT
ACCTGCTGGCCCAGGGTATCGATGGGGTGCCCTCCTCTAACGCGCCGTTCTTCAGCATGCTCCAGGACCAAGCCGTCATC
CAGACAAATGCCGAGGACAAGGCCATTTGGACGGCCACGGTAGACAACGGTGCTGGATGGAGAAACAAGTTCACGCTACT
CAAGATTGCTCCAGCCTTGATCTGGACAGATGCTGCCGAGCGCCCCTCACCCTACAGCGGATCACTGGTCGTTGAAGATG
GAACCGCCTCAACGGAAAAGCCGGAAACGACCTGTGAAATTCCCAACGGGCCGGCTGAACAGCAGCAAGCACCAGAAACG
AAGATGATGCTCCATCAACCTGCGCCGAGCGTTGCGAAACCGGCAAACGAGACGCAGGCGATTGCGAAACCCTCAACTGA
TGATCAAGAAGAAACAGACGATTTGTATGCACTTCTTGGTAATATCAATTCGCCACTAGAAGAGCTAGACACTAGCCACG
ACTCGCCGGCTGCCTCTCCTACGAACACACGCGGGGAGGAGAACCTACAGCAGCCACTAGGGACCAAGGAGCCAACAGAT
TGCGCTCCTGAAGCAATTGAAGATGTATTTATGCCTAGCAGAAGTACTGATCTGGGACAGGGATTCGTTGGTTGGATGAA
ATCTGGCATCGCGGCCCGTCGCCTGTTCATCAACGACACCAAGGCTTTGGTGCATACCGTAGACGGGACCGCCATGCTGG
TCACGCCAGGAATTTTCAAGCGCTATGTCCAAGAGCATCCGGTGCTTGAAAAACTGGCCCAAGCCAAGGAGACGACCGGC
TGGAAGCTGGTGCAGCGCGCGTTCGAAAAACAGGGGCTTCATCGGAAGACCAGTAAAAACCTGAACATCTGGACCATCAA
GGTTTCTGGTCCTCGCAAGACGAAAGAGCTCAAGGCCTACCTGCTCCAGGATCCCAAATTGCTGTTCCCTGAGCAGCCTC
TGGACAACCCAAGCCTCACGGTCATCACCGATGCCGAAGGAGGTGTGGAATGA

Fig. 6E

ORF5--33A9 SEQ ID NO:193

ATGCTCCAGGACCAAGCCGTCATCCAGACAAATGCCGAGGACAAGGCCATTTGGACGGCCACGGTAGACAACGGTGCTGG
ATGGAGAAACAAGTTCACGCTACTCAAGATTGCTCCAGCCTTGATCTGGACAGATGCTGCCGAGCGCCCCTCACCCTACA
GCGGATCACTGGTCGTTGAAGATGGAACCGCCTCAACGGAAAAGCCGGAAACGACCTGTGAAATTCCCAACGGGCCGGCT
GAACAGCAGCAAGCACCAGAAACGAAGATGATGCTCCATCAACCTGCGCCGAGCGTTGCGAAACCGGCAAACGAGACGCA
GGCGATTGCGAAACCCTCAACTGATGATCAAGAAGAAACAGACGATTTGTATGCACTTCTTGGTAATATCAATTCGCCAC
TAGAAGAGCTAGACACTAGCCACGACTCGCCGGCTGCCTCTCCTACGAACACACGCGGGGAGGAGAACCTACAGCAGCCA
CTAGGGACCAAGGAGCCAACAGATTGCGCTCCTGAAGCAATTGAAGATGTATTTATGCCTAGCAGAAGTACTGATCTGGG
ACAGGGATTCGTTGGTTGGATGAAATCTGGCATCGCGGCCCGTCGCCTGTTCATCAACGACACCAAGGCTTTGGTGCATA
CCGTAGACGGGACCGCCATGCTGGTCACGCCAGGAATTTTCAAGCGCTATGTCCAAGAGCATCCGGTGCTTGAAAAACTG
GCCCAAGCCAAGGAGACGACCGGCTGGAAGCTGGTGCAGCGCGCGTTCGAAAAACAGGGGCTTCATCGGAAGACCAGTAA
AAACCTGAACATCTGGACCATCAAGGTTTCTGGTCCTCGCAAGACGAAAGAGCTCAAGGCCTACCTGCTCCAGGATCCCA
AATTGCTGTTCCCTGAGCAGCCTCTGGACAACCCAAGCCTCACGGTCATCACCGATGCCGAAGGAGGTGTGGAATGA

Fig. 6F

ORF6--33A9 SEQ ID NO:194

ATGATGCTCCATCAACCTGCGCCGAGCGTTGCGAAACCGGCAAACGAGACGCAGGCGATTGCGAAACCCTCAACTGATGA
TCAAGAAGAAACAGACGATTTGTATGCACTTCTTGGTAATATCAATTCGCCACTAGAAGAGCTAGACACTAGCCACGACT
CGCCGGCTGCCTCTCCTACGAACACACGCGGGGAGGAGAACCTACAGCAGCCACTAGGGACCAAGGAGCCAACAGATTGC
GCTCCTGAAGCAATTGAAGATGTATTTATGCCTAGCAGAAGTACTGATCTGGGACAGGGATTCGTTGGTTGGATGAAATC
TGGCATCGCGGCCCGTCGCCTGTTCATCAACGACACCAAGGCTTTGGTGCATACCGTAGACGGGACCGCCATGCTGGTCA
CGCCAGGAATTTTCAAGCGCTATGTCCAAGAGCATCCGGTGCTTGAAAAACTGGCCCAAGCCAAGGAGACGACCGGCTGG
AAGCTGGTGCAGCGCGCGTTCGAAAAACAGGGGCTTCATCGGAAGACCAGTAAAAACCTGAACATCTGGACCATCAAGGT
TTCTGGTCCTCGCAAGACGAAAGAGCTCAAGGCCTACCTGCTCCAGGATCCCAAATTGCTGTTCCCTGAGCAGCCTCTGG
ACAACCCAAGCCTCACGGTCATCACCGATGCCGAAGGAGGTGTGGAATGA

Fig. 6G

ORF7--33A9 SEQ ID NO:195

ATGCTCCATCAACCTGCGCCGAGCGTTGCGAAACCGGCAAACGAGACGCAGGCGATTGCGAAACCCTCAACTGATGATCA
AGAAGAAACAGACGATTTGTATGCACTTCTTGGTAATATCAATTCGCCACTAGAAGAGCTAGACACTAGCCACGACTCGC
CGGCTGCCTCTCCTACGAACACACGCGGGGAGGAGAACCTACAGCAGCCACTAGGGACCAAGGAGCCAACAGATTGCGCT
CCTGAAGCAATTGAAGATGTATTTATGCCTAGCAGAAGTACTGATCTGGGACAGGGATTCGTTGGTTGGATGAAATCTGG
CATCGCGGCCCGTCGCCTGTTCATCAACGACACCAAGGCTTTGGTGCATACCGTAGACGGGACCGCCATGCTGGTCACGC
CAGGAATTTTCAAGCGCTATGTCCAAGAGCATCCGGTGCTTGAAAAACTGGCCCAAGCCAAGGAGACGACCGGCTGGAAG
CTGGTGCAGCGCGCGTTCGAAAAACAGGGGCTTCATCGGAAGACCAGTAAAAACCTGAACATCTGGACCATCAAGGTTTC
TGGTCCTCGCAAGACGAAAGAGCTCAAGGCCTACCTGCTCCAGGATCCCAAATTGCTGTTCCCTGAGCAGCCTCTGGACA
ACCCAAGCCTCACGGTCATCACCGATGCCGAAGGAGGTGTGGAATGA

Fig. 6H

ORF8--33A9 SEQ ID NO:196

ATGCCTAGCAGAAGTACTGATCTGGGACAGGGATTCGTTGGTTGGATGAAATCTGGCATCGCGGCCCGTCGCCTGTTCAT
CAACGACACCAAGGCTTTGGTGCATACCGTAGACGGGACCGCCATGCTGGTCACGCCAGGAATTTTCAAGCGCTATGTCC
AAGAGCATCCGGTGCTTGAAAAACTGGCCCAAGCCAAGGAGACGACCGGCTGGAAGCTGGTGCAGCGCGCGTTCGAAAAA
CAGGGGCTTCATCGGAAGACCAGTAAAAACCTGAACATCTGGACCATCAAGGTTTCTGGTCCTCGCAAGACGAAAGAGCT
CAAGGCCTACCTGCTCCAGGATCCCAAATTGCTGTTCCCTGAGCAGCCTCTGGACAACCCAAGCCTCACGGTCATCACCG
ATGCCGAAGGAGGTGTGGAATGA

Fig. 6I

ORF9--33A9 SEQ ID NO:197

ATGAAATCTGGCATCGCGGCCCGTCGCCTGTTCATCAACGACACCAAGGCTTTGGTGCATACCGTAGACGGGACCGCCAT
GCTGGTCACGCCAGGAATTTTCAAGCGCTATGTCCAAGAGCATCCGGTGCTTGAAAAACTGGCCCAAGCCAAGGAGACGA
CCGGCTGGAAGCTGGTGCAGCGCGCGTTCGAAAAACAGGGGCTTCATCGGAAGACCAGTAAAAACCTGAACATCTGGACC
ATCAAGGTTTCTGGTCCTCGCAAGACGAAAGAGCTCAAGGCCTACCTGCTCCAGGATCCCAAATTGCTGTTCCCTGAGCA
GCCTCTGGACAACCCAAGCCTCACGGTCATCACCGATGCCGAAGGAGGTGTGGAATGA

Fig. 6J

ORF10-33A9 SEQ ID NO:198

ATGCTGGTCACGCCAGGAATTTTCAAGCGCTATGTCCAAGAGCATCCGGTGCTTGAAAAACTGGCCCAAGCCAAGGAGAC
GACCGGCTGGAAGCTGGTGCAGCGCGCGTTCGAAAAACAGGGGCTTCATCGGAAGACCAGTAAAAACCTGAACATCTGGA
CCATCAAGGTTTCTGGTCCTCGCAAGACGAAAGAGCTCAAGGCCTACCTGCTCCAGGATCCCAAATTGCTGTTCCCTGAG
CAGCCTCTGGACAACCCAAGCCTCACGGTCATCACCGATGCCGAAGGAGGTGTGGAATGA

Fig. 6K

ORF 1--33A9 SEQ ID NO:199

MEPPMFQLLSWISRKPSPTPTTKAAPGGFILPLSSMELLGTPRRRQLLENIWQRASLSKQQFEEIYRRPLANYAELVQQL
PASENHHHAHPGGMIDHGLEIVAYALKVRQTYLLPIGAAPESQSAQAEAWSAAAAYGALAHDIGKIVVDLQVELQDGSTW
HPWNGPINQPYRFKYVKSREYQLHGAASALLIHQLLPRTALDWLSRFPELWAQLIYLFAGQYEHAGILGEIIVKADQASV
AQELGGNPDRALAAPKQSLQRQLADGLRFLVKDKFKLNQPSGPSDGWLTQDALWLVSKPAADQLRAYLLAQGIDGVPSSN
APFFSMLQDQAVIQTNAEDKAIWTATVDNGAGWRNKFTLLKIAPALIWTDAAERPSPYSGSLVVEDGTASTEKPETTCEI
PNGPAEQQQAPETKMMLHQPAPSVAKPANETQAIAKPSTDDQEETDDLYALLGNINSPLEELDTSHDSPAASPTNTRGEE
NLQQPLGTKEPTDCAPEAIEDVFMPSRSTDLGQGFVGWMKSGIAARRLFINDTKALVHTVDGTAMLVTPGIFKRYVQEHP
VLEKLAQAKETTGWKLVQRAFEKQGLHRKTSKNLNIWTIKVSGPRKTKELKAYLLQDPKLLFPEQPLDNPSLTVITDAEG
GVE.

Fig. 6L

ORF2--33A9 SEQ ID NO:200

MFQLLSWISRKPSPTPTTKAAPGGFILPLSSMELLGTPRRRQLLENIWQRASLSKQQFEEIYRRPLANYAELVQQLPASE
NHHHAHPGGMIDHGLEIVAYALKVRQTYLLPIGAAPESQSAQAEAWSAAAAYGALAHDIGKIVVDLQVELQDGSTWHPWN
GPINQPYRFKYVKSREYQLHGAASALLIHQLLPRTALDWLSRFPELWAQLIYLFAGQYEHAGILGEIIVKADQASVAQEL
GGNPDRALAAPKQSLQRQLADGLRFLVKDKFKLNQPSGPSDGWLTQDALWLVSKPAADQLRAYLLAQGIDGVPSSNAPFF
SMLQDQAVIQTNAEDKAIWTATVDNGAGWRNKFTLLKIAPALIWTDAAERPSPYSGSLVVEDGTASTEKPETTCEIPNGP
AEQQQAPETKMMLHQPAPSVAKPANETQAIAKPSTDDQEETDDLYALLGNINSPLEELDTSHDSPAASPTNTRGEENLQQ
PLGTKEPTDCAPEAIEDVFMPSRSTDLGQGFVGWMKSGIAARRLFINDTKALVHTVDGTAMLVTPGIFKRYVQEHPVLEK
LAQAKETTGWKLVQRAFEKQGLHRKTSKNLNIWTIKVSGPRKTKELKAYLLQDPKLLFPEQPLDNPSLTVITDAEGGVE.

Fig. 6M

ORF2-33A9 SEQ ID NO:201

MELLGTPRRRQLLENIWQRASLSKQQFEEIYRRPLANYAELVQQLPASENHHHAHPGGMIDHGLEIVAYALKVRQTYLLP
IGAAPESQSAQAEAWSAAAAYGALAHDIGKIVVDLQVELQDGSTWHPWNGPINQPYRFKYVKSREYQLHGAASALLIHQL
LPRTALDWLSRFPELWAQLIYLFAGQYEHAGILGEIIVKADQASVAQELGGNPDRALAAPKQSLQRQLADGLRFLVKDKF
KLNQPSGPSDGWLTQDALWLVSKPAADQLRAYLLAQGIDGVPSSNAPFFSMLQDQAVIQTNAEDKAIWTATVDNGAGWRN
KFTLLKIAPALIWTDAAERPSPYSGSLVVEDGTASTEKPETTCEIPNGPAEQQQAPETKMMLHQPAPSVAKPANETQAIA
KPSTDDQEETDDLYALLGNINSPLEELDTSHDSPAASPTNTRGEENLQQPLGTKEPTDCAPEAIEDVFMPSRSTDLGQGF
VGWMKSGIAARRLFINDTKALVHTVDGTAMLVTPGIFKRYVQEHPVLEKLAQAKETTGWKLVQRAFEKQGLHRKTSKNLN
IWTIKVSGPRKTKELKAYLLQDPKLLFPEQPLDNPSLTVITDAEGGVE.

Fig. 6N

ORF4-33A9 SEQ ID NO:202

MIDHGLEIVAYALKVRQTYLLPIGAAPESQSAQAEAWSAAAAYGALAHDIGKIVVDLQVELQDGSTWHPWNGPINQPYRF
KYVKSREYQLHGAASALLIHQLLPRTALDWLSRFPELWAQLIYLFAGQYEHAGILGEIIVKADQASVAQELGGNPDRALA
APKQSLQRQLADGLRFLVKDKFKLNQPSGPSDGWLTQDALWLVSKPAADQLRAYLLAQGIDGVPSSNAPFFSMLQDQAVI
QTNAEDKAIWTATVDNGAGWRNKFTLLKIAPALIWTDAAERPSPYSGSLVVEDGTASTEKPETTCEIPNGPAEQQQAPET
KMMLHQPAPSVAKPANETQAIAKPSTDDQEETDDLYALLGNINSPLEELDTSHDSPAASPTNTRGEENLQQPLGTKEPTD
CAPEAIEDVFMPSRSTDLGQGFVGWMKSGIAARRLFINDTKALVHTVDGTAMLVTPGIFKRYVQEHPVLEKLAQAKETTG
WKLVQRAFEKQGLHRKTSKNLNIWTIKVSGPRKTKELKAYLLQDPKLLFPEQPLDNPSLTVITDAEGGVE.

Fig. 6O

ORF5--33A9 SEQ ID NO:203

MLQDQAVIQTNAEDKAIWTATVDNGAGWRNKFTLLKIAPALIWTDAAERPSPYSGSLVVEDGTASTEKPETTCEIPNGPA
EQQQAPETKMMLHQPAPSVAKPANETQAIAKPSTDDQEETDDLYALLGNINSPLEELDTSHDSPAASPTNTRGEENLQQP
LGTKEPTDCAPEAIEDVFMPSRSTDLGQGFVGWMKSGIAARRLFINDTKALVHTVDGTAMLVTPGIFKRYVQEHPVLEKL
AQAKETTGWKLVQRAFEKQGLHRKTSKNLNIWTIKVSGPRKTKELKAYLLQDPKLLFPEQPLDNPSLTVITDAEGGVE.

Fig. 6P

ORF6-33A9 SEQ ID NO:204

MMLHQPAPSVAKPANETQAIAKPSTDDQEETDDLYALLGNINSPLEELDTSHDSPAASPTNTRGEENLQQPLGTKEPTDC
APEAIEDVFMPSRSTDLGQGFVGWMKSGIAARRLFINDTKALVHTVDGTAMLVTPGIFKRYVQEHPVLEKLAQAKETTGW
KLVQRAFEKQGLHRKTSKNLNIWTIKVSGPRKTKELKAYLLQDPKLLFPEQPLDNPSLTVITDAEGGVE.

Fig. 6Q

ORF7-33A9 SEQ ID NO:205

MLHQPAPSVAKPANETQAIAKPSTDDQEETDDLYALLGNINSPLEELDTSHDSPAASPTNTRGEENLQQPLGTKEPTDCA
PEAIEDVFMPSRSTDLGQGFVGWMKSGIAARRLFINDTKALVHTVDGTAMLVTPGIFKRYVQEHPVLEKLAQAKETTGWK
LVQRAFEKQGLHRKTSKNLNIWTIKVSGPRKTKELKAYLLQDPKLLFPEQPLDNPSLTVITDAEGGVE.

Fig. 6R

ORF8--33A9 SEQ ID NO:206

MPSRSTDLGQGFVGWMKSGIAARRLFINDTKALVHTVDGTAMLVTPGIFKRYVQEHPVLEKLAQAKETTGWKLVQRAFEK
QGLHRKTSKNLNIWTIKVSGPRKTKELKAYLLQDPKLLFPEQPLDNPSLTVITDAEGGVE.

Fig. 6S

ORF9--33A9 SEQ ID NO:207

MKSGIAARRLFINDTKALVHTVDGTAMLVTPGIFKRYVQEHPVLEKLAQAKETTGWKLVQRAFEKQGLHRKTSKNLNIWT
IKVSGPRKTKELKAYLLQDPKLLFPEQPLDNPSLTVITDAEGGVE.

Fig. 6T

ORF10--33A9 SEQ ID NO:208

MLVTPGIFKRYVQEHPVLEKLAQAKETTGWKLVQRAFEKQGLHRKTSKNLNIWTIKVSGPRKTKELKAYLLQDPKLLFPE
QPLDNPSLTVITDAEGGVE.

Fig. 6U

Sequence: 34B12 EcoR1 fragment From: 1 To: 4590

```
           10         20         30         40         50         60
GAATTCCATG GCGCCGTGGA GGAGGCTTCC GAGTCGCCGG TGGCAGGCGT ACGGGCCGGC  60
AACTACCAGG TCGACCTGGA CGATGCGAGC TTTGCCCGCC AGGTAGAACG CCTGCAGGCC 120
CACGTGAGGG CCGGCGACGT GTTCCAGATC GTACCTTCGC GCAGCTTCAG CATGCCGTGC 180
GCGGACCCCT GGCGGGCCTA TCGCCAGTTG TGCCTGCGCA ACCCCAGCCC GTACCGCTTC 240
TTCCTCGATG CGGGGGACTT CTGCCTGTTC GGCGCTTCGC CGGAGTCGGC ATTGAAGTAC 300
          310        320        330        340        350        360
GACGCGGAGA GTCGCGAGGT GGAACTCTAT CCCATTGCCG GCACCCGCCC GCGCGGATGC 360
GATGCCCGGG GCGCCATCGA TGCGGAACTG GACAATCGCC TGGAAGCGGA GTTGCGCCTG 420
GATGCCAAGG AGATCGCCGA GCACATGATG CTGGTCGACC TGGCGCGCAA CGATCTGGCG 480
CGCGTCTGCC GCAGCGGTAC CCGGCAGGTG CGCGACATGC TCAAGGTCGA TCGCTACAGC 540
CACGTGATGC ACCTGGTCTC GCGCGTGGCT GGCGAACTGC ACGGCGAACT GGATGCGCTG 600
          610        620        630        640        650        660
CATGCCTACC GTGCCTGCCT GAACATGGGC ACCCTGGTCG GCGCGCCGAA GGTCCGTGCC 660
ATGCAGTTGC TGCGGCAGTA CGAGGATGGC TATCGCGGCA GCTACGGTGG TGCGATCGGC 720
ATTCTCGACA GCGCCGGCAA CCTCGATACC AGCATTGTCA TCCGCTCCGC CGAGGTCCGC 780
GAAGGTATCG CGCGGGTTCG GGCAGGCGCC GGCGTGGTGC TGGATTCGGA TCCACGGCTG 840
GAGGCCGAGG AAACCCGCAA CAAGGCGCTG GCGGTGCTGA CCGCCGTGGC CGCTGCCGAA 900
          910        920        930        940        950        960
CGCGAAAGGG GAGAGCGCGA TGCGCATCAC GCTGTTGGAT AACTTCGATT CCTTCACCTA 960
CAACCTGGTC GAGCAGTTCT GCCTGCTCGG CGCGGAGGTC CGGGTGATGC GCAACGATAC 1020
GCCGTTGCCG ACGATCCAGG CGGCATTGCT GGCCGACGGT TGCGAACTGC TGGTGCTGTC 1080
GCCGGGGCCC GGTCGGCCGG AAGACGCCGG CTGTATGCTG GAATTGCTCG CCTGGGCCCG 1140
CGGGCGCTTG CCGGTGCTCG GCGTCTGCCT CGGCCACCAG GCGCTGGCGC TGGCCGCCGG 1200
         1210       1220       1230       1240       1250       1260
TGGCGCGGTG GGCGAGGCGA GGAAGCCGCT GCATGGCAAG AGCACGTCCC TGCGTTTCGA 1260
TCAGCGTCAC CCGCTGTTCG ACGGCATCGC TGACCTGCGC GTCGCGCGCT ACCACTCGCT 1320
GGTGGTCAGT CGCCTGCCGG AAGGTTTCGA CTGCCTGGCC GATGCCGATG CGAGATCAT  1380
GGCGATGGCC GATCCGCGCA ATCGACAGCT GGGCTTGCAA TTCCATCCCG AGTCGATTCT 1440
CACCACCCAC GGCCAGCGTC TGCTGGAGAA CGCTCTACTC TGGTGCGGCG CGTTGGCGGT 1500
```

Fig. 7B

Sequence: 34B12 EcoRl fragment From: 1 To: 4590

```
             1510       1520       1530       1540       1550       1560
       ┬┴┴┴┴┴┴┴┴┴┤┴┴┴┴┴┴┴┴┴┴┤┴┴┴┴┴┴┴┴┴┴┤┴┴┴┴┴┴┴┴┴┴┤┴┴┴┴┴┴┴┴┴┴┤┴┴┴┴┴┴┴┴┴┴┤
CGCGGAGCGC CTTCGGGCCT GAGCGGCGCT GCGCAGTTTC GACCGAGGCT CGGTTGCCAG 1560
GCCGGCGCAT CGTCGAAACG CTGGCGGCCC AGTTCGCGCA GGCGCTGGCG GGCGCTTTCG 1620
AGAAAGCGAC GGAAGCTGCG CTCGGATTCC AGCGCGGTGT TGTAGTAGCA ATACACCTTG 1680
GTGTCGATGC CGCCCGGTTC GTACAGTTCG CTGAGGACTG CCAGGGTACC GTTGCGCAGG 1740
CGTTCCTCGA CGAAATAATG CGGCGAGATG CCCCATCCGA CGCCGGCTTC CACCAGACGC 1800
             1810       1820       1830       1840       1850       1860
       ┬┴┴┴┴┴┴┴┴┴┤┴┴┴┴┴┴┴┴┴┴┤┴┴┴┴┴┴┴┴┴┴┤┴┴┴┴┴┴┴┴┴┴┤┴┴┴┴┴┴┴┴┴┴┤┴┴┴┴┴┴┴┴┴┴┤
AGCATGTCGT CGAAGTTTTC CACGAAGAGC ACCTTGTCGC TGACCGGCCG CAGCAGGTTC 1860
GAATGCTGCC CGGAGCGGCT GCCGAGGCTG ATCTGCCGGT AATTGGCCAG GCTCGCGATG 1920
CTGTGCAGGG AGGCATTGCA CAACGGGTGC TGCGGATGGG CGACGACGAA CGCCTTGGTG 1980
TAGCCGAGCA CGCACTGGTT GAAGCGGGAG ATCTTCAGTT CCTCGTCGAT GGTGATGGCG 2040
ATATCGATTT CCGCGTTGTC CTGCTTGATC GTCGCCAGGC TATCGGCGGG CGAGGTGCGT 2100
             2110       2120       2130       2140       2150       2160
       ┬┴┴┴┴┴┴┴┴┴┤┴┴┴┴┴┴┴┴┴┴┤┴┴┴┴┴┴┴┴┴┴┤┴┴┴┴┴┴┴┴┴┴┤┴┴┴┴┴┴┴┴┴┴┤┴┴┴┴┴┴┴┴┴┴┤
ATCAGGCTGA CCATGTTGAA ATCGTCGAGC AGTACGCTGC TCACCGTATC GCAGAACGAC 2160
GGCGGGATGG CGGTGTCCAG CAGCACCCGG AGATTGCGCG GACCCTTGTT GAGATTGAAG 2220
GCGATGTCGC CGATCAGCTG CTGGTAGTTC AGCAGGCTGC GCATGTAAGG GATCAGGCGA 2280
AGCGCCTGCT CGGTGGGTTC GACCTTGTAG CCGTCCCGAC GGACCAGCTC CACGCACAGG 2340
TCGATTTCCA GGTTGCTGAC CGCCGAGCTG ACCGCGGTGT GCGACTTGCG CAGGATCCGC 2400
             2410       2420       2430       2440       2450       2460
       ┬┴┴┴┴┴┴┴┴┴┤┴┴┴┴┴┴┴┴┴┴┤┴┴┴┴┴┴┴┴┴┴┤┴┴┴┴┴┴┴┴┴┴┤┴┴┴┴┴┴┴┴┴┴┤┴┴┴┴┴┴┴┴┴┴┤
GCAGCGGAGG AAATCGAACC GGAGGCGATG ACCTGGAGGA ACATGTTCAC GTGATTCAGG 2460
TTATGAATAG GCATCCCTTA TTCCTTTTAT TGGGTGGCGC GTGCCGCTTC CCTTGATCGG 2520
GTCAGGTTGC CGCTACTGTG GAAGAAGCGT CGAGGACTCG ATAGATAGCG CCCGAGTGTT 2580
TCAACTTGTC TTCTGGATGA CGTTTTCATC GGGGAAACCT CCCGTCGGTC AGTGAATCGC 2640
AAGGGCTGGC GTGCGAGGGT GGAATCGGCC GCCGGCTCGC TTTCTGCGCG GCGGGCGCAC 2700
             2710       2720       2730       2740       2750       2760
       ┬┴┴┴┴┴┴┴┴┴┤┴┴┴┴┴┴┴┴┴┴┤┴┴┴┴┴┴┴┴┴┴┤┴┴┴┴┴┴┴┴┴┴┤┴┴┴┴┴┴┴┴┴┴┤┴┴┴┴┴┴┴┴┴┴┤
GGCACGGGGA GTCGTCGTTT TGGAGGTGAG GGATGACGGC TCTGTTTCAG GATATTTTTA 2760
TAATTATGTG AAAGAAGAGC TTATTTCAAC GAAATATGTT TCATATTGCT CGTTAAATTC 2820
GACGAAAAGA AAATCCGGAT ATTTACCGGT TATTTAACGC TAATACCAAG TGCCTAATAC 2880
CAAAGTATTA ACGCTGGTAT GCCGGCATGT CGTGTTCGGT CGTGGAGCGA CCGAGCTAG 2940
GGACGGTTCT AATAAACCAA AAAATTATGT CGCGTACGTC TAACGACCGA AACCTATGTC 3000
```

Fig. 7C

Sequence: 34B12 EcoR1 fragment From: 1 To: 4590

```
              3010       3020       3030       3040       3050       3060
          |||||||||| |||||||||| |||||||||| |||||||||| |||||||||| ||||||||||
TCTTGTTAGC GTAGCCACCG GCCAGGCCGG TACGGACCCG GGATGGCCCT GGCGCGACCT 3060
ATGCGGTTAG AATCCGCGGC CTTGCAGGCG GATACCCGAG CTTCGCTCGA AGGTGTCGCG 3120
GTGCCGTGCC GTGGAATCGG CCGCCGGCTC GCTTTCTGCG CGGCGGGCGC ACGGCGACGG 3180
GGAGTCGTCG TTTTGGAGGT GAGGGATGAC GGCTCTGTTT CAGGATATTT TTATAATTAT 3240
GTGAAAGAAG AGCTTATTTC AACGAAATAT GTTTCATATT GCTCGTAAAT TCGACGAAAA 3300
              3310       3320       3330       3340       3350       3360
          |||||||||| |||||||||| |||||||||| |||||||||| |||||||||| ||||||||||
GAAAATCCGG ATATTTACCG GTTATTTAAC GTTAATACCA AGGGCCTAAT ACCAAAGTAT 3360
TAACGCTGGC ATGCCGGCAT GTCGTGTTCG GTCGTGGAGC GAGCCGAGCC AGGAACGGTT 3420
CTAAGAAACG AAAAAATTAT GTCGCGTAGG TCTAACGACC GAAACCTATG TCTTTTGTTA 3480
GCGTAGCCAC CGGCCAGGCC GGTACGGATG CCGGGATGGC CCTGGCGCGA CCTATGCGGT 3540
TAGAATCCGC GGCCTTGCAG GCGGATCCCC GGGGTTTGCT CAAGGGGACA CGGGTGCCGT 3600
              3610       3620       3630       3640       3650       3660
          |||||||||| |||||||||| |||||||||| |||||||||| |||||||||| ||||||||||
GCCCGAAACC TGCAATCGTC AGTTCCCTGC GGTCCAGCCT GCCGCCGGGT ATAAAATCGA 3660
GAGACGCGCT GTTGCGCCTT CAGGTGTAGC GACTATGACG CACATTTCCG AACGACTCCT 3720
GGTACAGGCC CACCTGGCCG CCAAGCAACC CCGTGTGTTG AGCGAGCAGG AGAGCGCCGA 3780
GCATCGCGCG GCGATCGCGG CCGAACTGAA GGCGCAAAAT GCTGTACTGG TGGCGCATTA 3840
CTACTGCGAC CCGGTGATCC AGGCGTTGGC CGAGGAGACC GGCGGTTGCG TATCCGATTC 3900
              3910       3920       3930       3940       3950       3960
          |||||||||| |||||||||| |||||||||| |||||||||| |||||||||| ||||||||||
GCTGGAGATG GCCCGTTTCG GCAACCAGCA TCCGGCGCAG ACGGTGGTCG TGGCCGGGGT 3960
GCGCTTCATG GGCGAGACGG CGAAGATCCT CAACCCTGAG AAGCGTGTGC TGATGCCGAC 4020
CCTCGAAGCG ACCTGCTCGC TCGACCTGGG ATGCCCGGTG GATGAATTCT CGGCTTTCTG 4080
CGACCAGCAC CCGGAACGGA CCGTGGTGGT CTATGCGAAC ACCTCCGCGG CGGTGAAGGC 4140
ACGCGCCGAC TGGGTCGTGA CCTCCAGTTG CGCGGTGGAG ATCGTCGAAC ACCTGATGGA 4200
              4210       4220       4230       4240       4250       4260
          |||||||||| |||||||||| |||||||||| |||||||||| |||||||||| ||||||||||
CAACGGCGAG CCCATCCTCT GGGCGCCGGA CCAGCACCTG GACGCTACA TCCAGCGCGA 4260
GACGGGGGCC GACATGCTGC TCTGGGATGG CGCCTGTATC GTCCACGAGG AGTTCAAGGC 4320
CAAGCAGCTG GAAGACATGA AGGCGCTCTA CCCGGACGCC GCCATCCTGG TCCACCCCGA 4380
ATCGCCGGAA AGCGTGGTCG CGCTGGCCGA TGCCGTGGGC TCGACCAGCC AGTTGATCAA 4440
GGCCGCGCAG ACCCTGCCGA ACAAGACCTT CATCGTCGCC ACCGATCGCG GCATCTTCTA 4500
```

Fig. 7D

Sequence: 34B12 EcoR1 fragment From: 1 To: 4590
```
         4510       4520       4530       4540       4550       4560
 ┬┴┴┴┬┴┴┴┴┬ ┴┴┴┴┬┴┴┴┴┬ ┴┴┴┴┬┴┴┴┴┬ ┴┴┴┴┬┴┴┴┴┬ ┴┴┴┴┬┴┴┴┴┬ ┴┴┴┴┬┴┴┴┴┬
```
CAAGATGCAG CAGTTGTGCC CGGACAAGGA TTTCATCGAG GCCCCCACCG CCGGCAACGG 4560
CGCCGCCTGC CGCAGTGCGC GCACTGCCCG 4590

Fig. 7E

Sequence: 34B12 ORF 1 L-S From: 1 To: 1284

```
         10         20         30         40         50         60
ATGGCAAGAG CACGTCCCTG CGTTTCGATC AGCGTCACCC GCTGTTCGAC GGCATCGCTG  60
ACCTGCGCGT CGCGCGCTAC CACTCGCTGG TGGTCAGTCG CCTGCCGGAA GGTTTCGACT 120
GCCTGGCCGA TGCCGATGGC GAGATCATGG CGATGGCCGA TCCGCGCAAT CGACAGCTGG 180
GCTTGCAATT CCATCCCGAG TCGATTCTCA CCACCCACGG CCAGCGTCTG CTGGAGAACG 240
CTCTACTCTG GTGCGGCGCG TTGGCGGTCG CGGAGCGCCT TCGGGCCTGA GCGGCGCTGC 300
        310        320        330        340        350        360
GCAGTTTCGA CCGAGGCTCG GTTGCCAGGC CGGCGCATCG TCGAAACGCT GGCGGCCCAG 360
TTCGCGCAGG CGCTGGCGGG CGCTTTCGAG AAAGCGACGG AAGCTGCGCT CGGATTCCAG 420
CGCGGTGTTG TAGTAGCAAT ACACCTTGGT GTCGATGCCG CCCGGTTCGT ACAGTTCGCT 480
GAGGACTGCC AGGGTACCGT TGCGCAGGCG TTCCTCGACG AAATAATGCG GCGAGATGCC 540
CCATCCGACG CCGGCTTCCA CCAGACGCAG CATGTCGTCG AAGTTTTCCA CGAAGAGCAC 600
        610        620        630        640        650        660
CTTGTCGCTG ACCGGCCGCA GCAGGTTCGA ATGCTGCCCG GAGCGGCTGC CGAGGCTGAT 660
CTGCCGGTAA TTGGCCAGGC TCGCGATGCT GTGCAGGGAG GCATTGCACA ACGGGTGCTG 720
CGGATGGGCG ACGACGAACG CCTTGGTGTA GCCGAGCACG CACTGGTTGA AGCGGGAGAT 780
CTTCAGTTCC TCGTCGATGG TGATGGCGAT ATCGATTTCC GCGTTGTCCT GCTTGATCGT 840
CGCCAGGCTA TCGGCGGGCG AGGTGCGTAT CAGGCTGACC ATGTTGAAAT CGTCGAGCAG 900
        910        920        930        940        950        960
TACGCTGCTC ACCGTATCGC AGAACGACGG CGGGATGGCG GTGTCCAGCA GCACCCGGAG 960
ATTGCGCGGA CCCTTGTTGA GATTGAAGGC GATGTCGCCG ATCAGCTGCT GGTAGTTCAG 1020
CAGGCTGCGC ATGTAAGGGA TCAGGCGAAG CGCCTGCTCG GTGGGTTCGA CCTTGTAGCC 1080
GTCCCGACGG ACCAGCTCCA CGCACAGGTC GATTTCCAGG TTGCTGACCG CCGAGCTGAC 1140
CGCGGTGTGC GACTTGCGCA GGATCCGCGC AGCGGAGGAA ATCGAACCGG AGGCGATGAC 1200
       1210       1220       1230       1240       1250       1260
CTGGAGGAAC ATGTTCACGT GATTCAGGTT ATGAATAGGC ATCCCTTATT CCTTTTATTG
GGTGGCGCGT GCCGCTTCCC TTGA 1284
```

Fig. 7F

Sequence: 34B12 ORF 1 (L-S) PROTEIN From: 1 To: 427

```
         10         20         30         40         50
MARARPCVSI SVTRCSTASL TCASRATTRW WSVACRKVST AWPMPMARSW
RWPIRAIDSW ACNSIPSRFS PPTASVCWRT LYSGAARWRS RSAFGPERRC
AVSTEARLPG RRIVETLAAQ FAQALAGAFE KATEAALGFQ RGVVVAIHLG
VDAARFVQFA EDCQGTVAQA FLDEIMRRDA PSDAGFHQTQ HVVEVFHEEY
LVADRPQQVR MLPGAATEAD LPVIGQARDA VQGGIAQRVL RMGDDERLGV
        260        270        280        290        300
AEHALVEAGD LQFLVDGDGD IDFRVVLLDR RQAIGGRGAY QADHVEIVEQ
YAAHRIAERR RDGGVQQHPE IARTLVEIEG DVADQLLVVQ QAAHVRDQAK
RLLGGFDLVA VPTDQLHAQV DFQVADRRAD RGVRLAQDPR SGGNRTGGDD
LEEHVHVIQV MNRHPLFLLL GGACRFP 427
```

Fig. 7G

Sequence: 34B12 ORF 2 From: 1 To: 1035

```
          10         20         30         40         50         60
ATGCCTATTC ATAACCTGAA TCACGTGAAC ATGTTCCTCC AGGTCATCGC CTCCGGTTCG  60
ATTTCCTCCG CTGCGCGGAT CCTGCGCAAG TCGCACACCG CGGTCAGCTC GGCGGTCAGC 120
AACCTGGAAA TCGACCTGTG CGTGGAGCTG GTCCGTCGGG ACGGCTACAA GGTCGAACCC 180
ACCGAGCAGG CGCTTCGCCT GATCCCTTAC ATGCGCAGCC TGCTGAACTA CCAGCAGCTG 240
ATCGGCGACA TCGCCTTCAA TCTCAACAAG GGTCCGCGCA ATCTCCGGGT GCTGCTGGAC 300
         310        320        330        340        350        360
ACCGCCATCC CGCCGTCGTT CTGCGATACG GTGAGCAGCG TACTGCTCGA CGATTTCAAC 360
ATGGTCAGCC TGATACGCAC CTCGCCCGCC GATAGCCTGG CGACGATCAA GCAGGACAAC 420
GCGGAAATCG ATATCGCCAT CACCATCGAC GAGGAACTGA AGATCTCCCG CTTCAACCAG 480
TGCGTGCTCG GCTACACCAA GGCGTTCGTC GTCGCCCATC CGCAGCACCC GTTGTGCAAT 540
GCCTCCCTGC ACAGCATCGC GAGCCTGGCC AATTACCGGC AGATCAGCCT CGGCAGCCGC 600
         610        620        630        640        650        660
TCCGGGCAGC ATTCGAACCT GCTGCGGCCG GTCAGCGACA AGGTGCTCTT CGTGGAAAAC 660
TTCGACGACA TGCTGCGTCT GGTGGAAGCC GGCGTCGGAT GGGGCATCTC GCCGCATTAT 720
TTCGTCGAGG AACGCCTGCG CAACGGTACC CTGGCAGTCC TCAGCGAACT GTACGAACCG 780
GGCGGCATCG ACACCAAGGT GTATTGCTAC TACAACACCG CGCTGGAATC CGAGCGCAGC 840
TTCCGTCGCT TTCTCGAAAG CGCCCGCCAG CGCCTGCGCG AACTGGGCCG CCAGCGTTTC 900
         910        920        930        940        950        960
GACGATGCGC CGGCCTGGCA ACCGAGCCTC GGTCGAAACT GCGCAGCGCC GCTCAGGCCC 960
GAAGGCGCTC CGCGACCGCC AACGCGCCGC ACCAGAGTAG AGCGTTCTCC AGCAGACGCT 1020
GGCCGTGGGT GGTGA 1035
```

Fig. 7H

Sequence: 34B12 ORF 2 PROTEIN From:: 1 To: 344

```
           10         20         30         40         50         60
MPIHNLNHVN MFLQVIASGS ISSAARILRK SHTAVSSAVS NLEIDLCVEL VRRDGYKVEP  60
TEQALRLIPY MRSLLNYQQL IGDIAFNLNK GPRNLRVLLD TAIPPSFCDT VSSVLLDDFN 120
MVSLIRTSPA DSLATIKQDN AEIDIAITID EELKISRFNQ CVLGYTKAFV VAHPQHPLCN 180
ASLHSIASLA NYRQISLGSR SGQHSNLLRP VSDKVLFVEN FDDMLRLVEA GVGWGIAPHY 240
FVEERLRNGT LAVLSELYEP GGIDTKVYCY YNTALESERS FRRFLESARQ RLRELGRQRF 300
          310        320        330        340        350        360
DDAPAWQPSL GRNCAAPLRP EGAPRPPTRR TRVERSPADA GRGW 344
```

Fig. 7I

Sequence: 34B12 ORF 1 From:: 1 To: 759

```
          10         20         30         40
 |||||||||| |||||||||| |||||||||| ||||||||||
ATGCGGCGAG ATGCCCCATC CGACGCCGGC TTCCACCAGA 40
CGCAGCATGT CGTCGAAGTT TTCCACGAAG AGCACCTTGT 80
CGCTGACCGG CCGCAGCAGG TTCGAATGCT GCCCGGAGCG 120
GCTGCCGAGG CTGATCTGCC GGTAATTGGC CAGGCTCGCG 160
ATGCTGTGCA GGGAGGCATT GCACAACGGG TGCTGCGGAT 200
          210        220        230        240
 |||||||||| |||||||||| |||||||||| ||||||||||
GGGCGACGAC GAACGCCTTG GTGTAGCCGA GCACGCACTG 240
GTTGAAGCGG GAGATCTTCA GTTCCTCGTC GATGGTGATG 280
GCGATATCGA TTTCCGCGTT GTCCTGCTTG ATCGTCGCCA 320
GGCTATCGGC GGGCGAGGTG CGTATCAGGC TGACCATGTT 360
GAAATCGTCG AGCAGTACGC TGCTCACCGT ATCGCAGAAC 400
          410        420        430        440
 |||||||||| |||||||||| |||||||||| ||||||||||
GACGGCGGGA TGGCGGTGTC CAGCAGCACC CGGAGATTGC 440
GCGGACCCTT GTTGAGATTG AAGGCGATGT CGCCGATCAG 480
CTGCTGGTAG TTCAGCAGGC TGCGCATGTA AGGGATCAGG 520
CGAAGCGCCT GCTCGGTGGG TTCGACCTTG TAGCCGTCCC 560
GACGGACCAG CTCCACGCAC AGGTCGATTT CCAGGTTGCT 600
          610        620        630        640
 |||||||||| |||||||||| |||||||||| ||||||||||
GACCGCCGAG CTGACCGCGG TGTGCGACTT GCGCAGGATC 640
CGCGCAGCGG AGGAAATCGA ACCGGAGGCG ATGACCTGGA 680
GGAACATGTT CACGTGATTC AGGTTATGAA TAGGCATCCC 720
TTATTCCTTT TATTGGGTGG CGCGTGCCGC TTCCCTTGA 759
```

Fig. 7J

Sequence: 34B12 ORF 1 S PROTEIN From:: 1 To: 253

```
         10         20         30         40
MRRDAPSDAG FHQTQHVVEV FHEEHLVADR PQQVRMLPGA  40
AAEADLPVIG QARDAVQGGI AQRVLRMGDD ERLGVAEHAL  80
VEAGDLQFLV DGDGDIDFRV VLLDRRQAIG GRGAYQADHV 120
EIVEQYAAHR IAERRRDGGV QQHPEIARTL VEIEGDVADQ 160
LLVVQQAAHV RDQAKRLLGG FDLVAVPTDQ LHAQVDFQVA 200
        210        220        230        240
DRRADRGVRL AQDPRSGGNR TGGDDLEEHV HVIQVMNRHP 240
LFLLLGGACR FP. 253
```

Fig. 7K pho34B12 ORF1 (L-S) SEQ ID NO:107

```
  1  MARARPCVSI SVTRCSTASL TCASRATTRW WSVACRKVST AWPMPMARSW
 51  RWPIRAIDSW ACNSIPSRFS PPTASVCWRT LYSGAARWRS RSAFGPERRC
101  AVSTEARLPG RRIVETLAAQ FAQALAGAFE KATEAALGFQ RGVVVAIHLG
151  VDAARFVQFA EDCQGTVAQA FLDEIMRRDA PSDAGFHQTQ HVVEVFHEEY
201  LVADRPQQVR MLPGAATEAD LPVIGQARDA VQGGIAQRVL RMGDDERLGV
251  AEHALVEAGD LQFLVDGDGD IDFRVVLLDR RQAIGGRGAY QADHVEIVEQ
301  YAAHRIAERR RDGGVQQHPE IARTLVEIEG DVADQLLVVQ QAAHVRDQAK
351  RLLGGFDLVA VPTDQLHAQV DFQVADRRAD RGVRLAQDPR SGGNRTGGDD
401  LEEHVHVIQV MNRHPLFLLL GGACRFP*
```

Fig. 8 phoB12 ORF2 SEQ ID NO: 108

```
  1  MPIHNLNHVN MFLQVIASGS ISSAARILRK SHTAVSSAVS NLEIDLCVEL
 51  VRRDGYKVEP TEQALRLIPY MRSLLNYQQL IGDIAFNLNK GPRNLRVLLD
101  TAIPPSFCDT VSSVLLDDFN MVSLIRTSPA DSLATIKQDN AEIDIAITID
151  EELKISRFNQ CVLGYTKAFV VAHPQHPLCN ASLHSIASLA NYRQISLGSR
201  SGQHSNLLRP VSDKVLFVEN FDDMLRLVEA GVGWGIAPHY FVEERLRNGT
251  LAVLSELYEP GGIDTKVYCY YNTALESERS FRRFLESARQ RLRELGRQRF
301  DDAPAWQPSL GRNCAAPLRP EGAPRPPTRR TRVERSPADA GRGW*
```

Fig. 9

36A4 SEQ ID NO: 109

```
  1  AAGGGTTTTG GCGGGGTCAT CCGAGTGACC CTGAGCATGC TCCTGGCGAT
 51  CTTCTTGTCG GTGCTGCTGG CGCCGGTGCG CATGCTGTTC CACACCCGCT
101  TCGTGCTGGC CGCCTTCCTC GGCTGGTC
```

Fig. 10

36A4 SEQ ID NO:110

```
  1  KGFGGVIRVT LSMLLAIFLS VLLAPVRMLF HTRFVLAAFL GW
```

Fig. 11 contig 2507 SEQ ID NO: 111

```
   1 CTACTGGGGC AAGCTGAAGA CGCCGTTCAA GCTGAGCTTC TATCACCAGG
  51 GCATGCACTT CGACACGCCG GTGAAGATCA ACGAGGTGAC CGCTACCACG
 101 GTCAAGCCGA TCAAGTACGA TCGCACCAAG TTCGATTTCG GATCCCTGAA
 151 GTTCGACGAG AATGCCACCA AGGATCTCGG CTATGCCGGT TTCCGCGTGC
 201 TCTATCCGAT CAACAAGGCC GACAAGCAGG ACGAGATCGC CACCTTCCTT
 251 GGCGCGAGCT ACTTCGCGT GGTCGGCAAG GGCCAGGTCT ACGGTCTGTC
 301 GGCGCGCGGC CTGGCGATCG ATACCGCGCT GCCTTCGGGC GAAGAGTTCC
 351 CGCGCTTCCG CGAATTCTGG ATCGAGCGGC CGAAGCGCAG GACAAGCAAC
 401 TGGTGATCTA CGCCCTGCTC GACTCGCCGC GGGCCACCGG CGCCTACCGC
 451 TTCGTGCTGC GTCCGGGCAA GGATGCGGTG ATGGATGTCC AGGCCCGCGT
 501 GTTCCTCCGC GACAAGGTCA GCAAGCTGGG CCTGGCGCCG CTGACCAGCA
 551 TGTACCTGTT CGGCTCCAAC CAGCCGTCCG AGCAGCACAA CTTCCGGCCC
 601 GAGCTGCATG ACTCCAGCGG CCTGCAGATC CATGCCGGCA ACGGCGAGTG
 651 GCTGTGGCGT CCGCTGAACA ATCCGAAGCA CCTGTCGGTG AGCACCTTCA
 701 GCGTGGAGAA CCCGAAAGGC TTCGGCCTGC TCCAGCGCGG CCGCGAGTTC
 751 TCCCGCTACG AAGACCTGGA TGACCGCTAC GACCTGCGTC CGAGTGCCTG
 801 GATCGAGCCG AAGGGCGACT GGGGCAAGGG CACCGTGGAA CTGGTGGAAA
 851 TCCCGACCCC GGACGAAACC AACGACAATA TCGTCGCGTT CTGGAACCCC
 901 GAGACCCAGC CTGAGGTCGG AAAGCCGCTG GACTTCGCCT ACCGCCTGCA
 951 CTGGACCATG GATGAAGACG AGCTGCACGA CCCGAAATCC TCCTGGGTCA
1001 AGCAGACCAT GCGCTCGGTC GGCGACGTGA AGCAGAAGAA CCTGATCCGC
1051 CAGCAGGACG GCAGCACCGC CCTGGTCGTC GACTTCGAAG GGCCGGCCCT
1101 GAAGGACCTG GCGCCGGACG CGCCGGTGAC CACCCAGGTC AGCACCGACA
1151 GCAACGCCGA GGTGGTGGAG AACAGCCTGC GTTACAACCC GGTCCTGAAA
1201 GGCTGGCGCC TGACGCTGCG GATCAAGGTC AAGGATCCGA AGAAGCCGGT
1251 GGAAATGCGC GCGGCGCTGG TCGACGAGGC GCAGAAGCCA CTGAGCGAAA
1301 CCTGGAGCTA TCAGCTGCCT GCCGATGAAT AACCCATCCA CTACGAAAGC
1351 ACCGCTGGCC GACTACCTCG CTCATCTTCC CCTGGCGGAA GAGGAGCGGG
1401 AGCGCCTTGG CGAGTCCGCT TCCTTCTCCG AGCTGCACGC TCGCCTGGCG
1451 GGAGCGGAAG CGCCGCTGC CGATGCCGGG GGCGATCCCG CCCTGGCCTC
1501 GGTACGCGCC CGCCTGCAGC TGGGCACCCC TGAGCTGGAC GACGCCGAGA
1551 TGTTCGGCGT CGACGCCCAG GGTCGCACCT TCCTCAAGAT TTCCCCGCCG
1601 ATCCGCCGTA CCAAGGTGAT TCCCGAGCCC TGGCGCACCA ACATCCTGGT
1651 GCGCGGCTGG CGTCGGCTGA CCGGACGCAG CAACCCGCCC AAGCCCAAGC
1701 GTGCCCTGCC GCGGGCCCGC TGGCAGCGGG TCGGCTCGCT GCGCCGGTTC
1751 ATCCTGCTGT TGTTGATGCT GGCGCAGACC TCGGTCGCCA CCTACTACAT
1801 GAAAGGCATC CTGCCCTACC AGGGCTGGGC CTTCGTCGAC CTGGAGGAGC
1851 TGGCCCAGCA GAGCCTGCTG GATACCGTCC AGCAGGTGCT GCCCTATGTC
1901 ATCCAGTTCG GCATCCTGGC GCTCTTCGCG ATCCTCTTCT GCTGGGTCTC
1951 GGCCGGCTTC TGGACCGCGC TGATGGGCTT CTGGGAGCTG CTCACCGGGC
2001 GTGACCGCTA CCGGATCTCC GGCAGCAGCG CCGGCAGCGA GCCGATCGCC
2051 GCCGACGCCC GCACGGCGAT CGTCATGCCG ATCTGCAACG AAGACGTGCC
2101 GCGGGTATTC GCCGGCCTGC GGGCGACCGT CGAGTCGATG GCCGCCACCG
2151 GCGAGATGGA GCGCTTCGAC TTCTTCGTCC TCAGCGACAC CAACGACCCG
2201 GATATCGCCG TCGCCGAGCA GCAGGCCTGG CTCGAGCTGT GCCGCGAGAC
2251 CAAGGGCTTC GGCAAGATCT TCTACCGTCG CCGCCGGCGC CGGGTGAAGC
2301 GCAAGAGCGG CAACATCGAC GACTTCTGCC GGCGCTGGGG CGGCGACTAC
2351 CGCTACATGG TGGTGATGGA CGCCGACAGC GTGATGAGCG GCGACTGCCT
```

Fig. 12A

```
2401 GGCCAAGCTG GTACGCCTGA TGGAGGCCAA TCCTGAGGCG GGGATCATCC
2451 AGACCGCGCC GAAGGCTCCG GCATGGACAC CCTGTATGCG CGCATGCAGC
2501 AGTTCGCCAC CCGCGTCTAC GGCCCGCTGT TCACCGCCGG CCTGCACTTC
2551 TGGCAACTCG GCGAGTCGCA CTACTGGGGC ACAACGCGA TCATCCGCAT
2601 GCAGCCCTTC ATCGACCACT GCGCCCTGGC GCCGTTGCCG GGCAAGGGCT
2651 CGTTCGCCGG CGCGATCCTG TCCACGACT TCGTCGAGGC TGCGTTGATG
2701 CGCCTTGCCG GCTGGGGCGT GTGGATCGCC TACGACTTCG ACGGCAGCTA
2751 CGAAGAACTG CCGCCGAACC TGCTCGACGA ACTCAAGCGC GACCGCCGCT
2801 GGTGCCACGG CAACCTGATG AACTTCCGCC TGTTCCTGGT CAAGGGCATG
2851 CACCCGGTGC ACCGCGCGGT GTTCCTCACC GGGGTCATGT CCTACCTGTC
2901 GGCGCCGTTG TGGTTCTTCT TCCTGGTGCT TTCCACGCG CTGCTGGCGG
2951 TGCACCAACT GATGGAGCCG CAGTACTTCC TGGAACCGCG GCAGCTGTTC
3001 CCGATCTGGC CGCAGTGGCA TCCGGAGAAG GCCATCGCGT TGTTCTCCAC
3051 CACCCTGACC CTGTTGTTCC TGCCCAAGCT GCTCAGCGTA ATGCTGATCT
3101 GGGCCAAGGG CGCCAAGGGT TTCGGCGGGG TGATCCGGGT GACCCTGAGC
3151 ATGCTCCTGG AGATGTTCTT CTCGGTGCTG CTGGCGCCGG TGCGCATGCT
3201 CTTCCACACC CGCTTCGTGC TGGCCGCCTT CCTCGGCTGG TCGGTGCAGT
3251 GGAACTCGCC GCAGCGCGAC GACGACGCCA CGCCCTGGAG CGAGGCGATC
3301 CGCCGGCACG CAATGCAGAC CCTGCTGGGT ATCGCCTGGA CCCTGCTGGT
3351 GGCCTGGCTC AACCCGCGCT TCCTGTGGTG GCTGTCGCCG ATCGTCGGTT
3401 CGCTGATCCT GTCGATCCCG GTATCGGTGA TCTCCAGCCG GGTGAAGCTG
3451 GGCCTGCGGG CCCGCTACGA AAAGCTGGTC CTGATCCCGG AGAGTACGAC
3501 ACGCCGCGCG ACTGCGCGCC ACCGACGAGT ACACCTACGA GAACCGCTGG
3551 CATGCGCTCA AGGATGGCTT CCTCAAGGCC GCCGTCGATC CGTTGCTCAA
3601 CGCCCTGGCC TGCGCCATGG GCACGGCTCG CCACAACCGT GCGCAGGCCA
3651 TCGAGACGGT GCGTGGCGAG CGTATCGGCA AGGCCATCGA TAAGGGCCCG
3701 GAACAGCTCG ACGGCGCCAC GCGCCTGGCT CTGTTGAGTG ACCCGGTAGC
3751 ACTTTCGCGC CTGCATACGC GGGTCTGGGA AGAGGACCGC GACGACTGGC
3801 TCGGCCGCTG GCGCAAGGCC GAGGCGGACG ACCCCACGC CGCCAGCGTA
3851 CCGCTGGCCC AGGTAGTGCC CGGCGACGCC GGCCTGCTGC CCGCCGCCCA
3901 GTCCTGATCC CATGCCCCCG GCGGAACGCC GCCGGGGGCA TGGGTCTGTT
3951 TCTTGCCTGT TTTCCCCGTG CGGCGCTGCT GTTACCCTGC GCCGGCAATC
4001 CAGAAAGTCT CGTATCGTTC GCCAGCTGAG GTACTATCGG CCGCCTTTTG
4051 CGCAGCCGGT CATGGCCTGC TGCCCGCCCG GGACGGCGAC ACGACGAGAG
4101 CATCCGTTCG ACGACTGTGT TTCTAAGACT GCTGGGGATT GGGGAATGAA
4201 AAAGTATCTT GCTTCATTGG TTCTGGGCGT CTGCGCCCTG GTGGGCGTGG
4251 CTTCGGTCCA GGCGGCCGGC GCGGTGGAGG ACGCGGTCAA GCGCGGCACC
4301 CTGCGGGTCG GCATGGACCC GACCTACATG CCGTTCGAGA TGACCAACAA
4351 GCGTGGCCAG ATCATCGGCT TCGAAGTCGA CCTGCTCAAG GCCATGGCCA
4401 AGTCCATGGG CGTCAAGCTG GAGCTGGTCT CCACCAGCTA CGACGGCATC
4451 ATCCCGGCGC TGCTGACCGA CAAGTTCGAC ATGATCGGCT CGGGCATGAC
4501 CCTGACCCAG GAGCGCAACC TGCGCCTGAA CTTCTCCGAG CCCTTCATCG
4551 TGGTCGGCCA GACCCTGCTG GTGCGCAAGG AACTGGAAGG CAAGATCAAG
4601 TCCTACAAGG ACCTGAACGA TCCGCAGTAC AGCATCACCT CGAAGATCGG
4651 CACCACCGGT GAGATCGTTG CCCGCAAGCT GATCAGCAAG GCCAAGTACC
4701 ACGGCTTCGA CAACGAGCCG GAAGCGGTGA TGGACGTGGT CAACGGCAAG
4751 GCCGACGCCT TCATCTACGA CTCGCCCTAC AACGTGGTGG CGGTGAGCAA
4801 GTTCGGCGCC GGCAAGCTGG TCTACCTCGA CCAGCCGTTC ACCTACGAGC
4851 CGCTGGCGTT CGGCCTGAAG AAAGGCGACT ACGACAGCAT CAATTTCATC
4901 AACAACTTCC TCCATCAGAT CCGCGAAGAC GGCACCTATC AGCGCATCCA
```

Fig. 12B

```
4951 CGACAAGTGG TTCAAGAACA CCGAGTGGCT GAAGGAAATG GAATGAACCG
5001 CTGACGGCCC CCGCGAAGGG GGCCGTCGTA CCTGCGCATT CCATCGTTCG
5051 AGAGAGTTTC CGTGACCAAG AAGAAACGTT CCGTCTGGCC CTGGCACCTG
5101 CTGACCGGGC TGATCCTGCT GGTCATGGCC TGGGCGCTGT GGTTCTCCAC
5151 CTCGCTGATT TCCTATGAAA TGGCGTGGGA CCGCGTTTCC GAGTACTTCG
5201 CTACCAGGCC GAGGAGCCGT TACGGGCCAA CGAGATCGGC CGGGTCGAGG
5251 CTATCGAGGA ACAGGGCAGG GACGCGCGCG TCACGCTGCT TGGCGAGACG
5301 GCGAGAAGCA GGTCGTGACC GTTGCCCAGG ACAGCCTGCA ATTCTCCGAA
5351 GCGACGACGT GGCCGAGGGC GACGCGGTCG GGGTGACCCG CCACTGGGCC
5401 GCCGGCACTG CTCTGGGGCC TGTGGACCAC CCTCTGGCTA TCGCTGGTGT
5451 CCGGTGCCAT CGGTCTGGCT ATCGGCCTGG TCGCCGGCCT CTGCCGGCTG
5501 TCGAAGAACC CGACCCTGCA CGACCTGTCG ACGATCTACG TCGAGCTGGT
5551 GCGCGGCACG CCGTTGCTGG TGCAGATCTT CATCTTCTAC TTCTTCATCG
5601 GCACCGTGCT CAACCTGTCC CGCGAGTTCG CCGGGGTTGC GGCGCTGGCG
5651 CTGTTCACCG GCGCCTACGT GGCCGAGATC ATCCGGGCCG GCGTGCAGTC
5701 CATCGCCCGC GGACAGAACG AGGCCGCCCG CTCCCTGGGC CTGAACGCCG
5751 GCCAGTCGAT GCGCTACGTG ATCCTGCCGC AGGCTTCAAG CGCGTGCTGC
5801 CGCCGCTGGC CGGGCAGTTC ATCAGCCTGG TCAAGGACAC CTCGCTGGTC
5851 TCGGTGATCG CCATCACCGA ACTGACCAAG AGCGGCCGCG AGGCGATCAC
5901 CCACTTCGTT CTCCAACTTC GAGATCTGGT TTCTGCGTCG CCGCGTTGTA
5951 CCTGCTGTTG AACCTGCCCC TTTCGCACAT GGCATCCCGA CTGGAGCGGA
6001 GGCTCGGACA AAGTGATTGA AGTACGCAAC CTGCTGAAGG TCTTCGATAC
6051 CCGCGGCCAG GTAGTGCGCG CGGTGGACGA CGTGAGTACC CGCGTGGCCA
6101 GGGGCGAGGT ACTGGTGGTG ATCGGTCCGT CCGGTTCCGG CAAGTCGACC
6151 TTCCTGCGCT GCCTGAACGG CCTGGAGGAG TTCGACGAAG GCTCGGTGAG
6201 CATCGACGGC GTCGACCTGG CCGACCCGAG GACCGACATC AATGCCTACC
6251 GCCGCGAAGT CGGCATGGTG TTCCAGCATT TCAACCTGTT CCCGCACATG
6301 ACCGTGCTCG AGAACCTCTG CCTGGCCCAA CGCGTGGTGC GCAAGCGCGG
6351 CAAGGCCGAG CGCGAGGCCA AGGCGCGGGC GCTGCTGGCC AAGGTCGGCA
6401 TCGGGCAGAA GGCCGACGAA TATCCCTCGC GCCTGTCCGG CGGCCAGCAG
6451 CAGCGCGTGG CGATCGCTCG CGCGTTGTGC ATGGACCCCA AGGTGATGCT
6501 GTTCGACGAA CCGACCTCGG CGCTCGATCC GGAGATGGTC GGCGAAGTCC
6551 TCGACGTCAT GAAGACCCTG GCCGTGGAAG GCATGACCAT GGTCTGCGTG
6601 ACCCACGAGA TGGGCTTTGC CCGCGAAGTG GCCGACGCG TGCTGTTCTT
6651 CGACCACGGC AAGCTGCTGG AGGACGCGCC GCCGGCGCAG TTCTTCGACA
6701 ATCCGCAGGA CCCGCGGGCC CAGGCCTTCC TCCGCCAGGT CCTCTAGTAC
6751 CGCGCTAGGC GAACGGCTTG CCCGGCGGCG GCAGGAGCGA CGTCGGACTC
6801 TGCCGCGCGG CCGGCTGGAT ATCGTTGTCC TCCAGCCAGT CCAGCGCCCA
6851 TTCGCGCAGG CGCTCGTTCT GGTAGCGGTA CCAGTCCTGC AACAGTTCCG
6901 GGTACTCCAT CAGAGAGTGC TTGAAGGCCT TGAACGGCTT GCGGCTCTGC
6951 AGCGCGTTG
```

Fig. 12C

23A2 DNA SEQ ID NO:112

1 CGAGGTTTCC GTCTACGAAG GCACCGGCTC GGTCACCATC CGCGCCGTGT
     51 TCCCCAACCC GAACAACGAG CTGCTCCCCG GCATGTTCGT TCACGCGCAG
    101 TTGCAGG

Fig. 13

23A2 peptide SEQ ID NO:113

1  EVSVYEGTGS VTIRAVFPNP NNELLPGMFV HAQLQ

Fig. 14A

SEQ ID NO:148
 DNA flanking the 23A2 locus.
 mexA partial sequence, mexB partial sequence

```
  1 ggccaggcaa acgcgatggc caccgtgcaa cagctcgacc cgatctacgt cgacgtcacc
 61 cagccgtcca ccgccctgtt gcgcatgcgc cgcgaactgg ccagcggcca gttggagcgc
121 gccggcgaca acgctgcgaa ggtctccctg aagctggagg acggtagcca atacccgctg
181 gaaggccgcc tcgaattctc cgaggtttcc gtcgacgaag gcaccggctc ggtcaccatc
241 cgcgccgtgt tccccaaccc gaacaacgag ctgctgcccg gcatgttcgt tcacgcgcag
301 ttgcaggaag gcgtcaagca gaaggccatc ctcgctccgc agcaaggcgt gacccgcgac
361 ctcaagggcc aggctaccgc gctggtggtg aacgcgcaga acaaggtcga gctgcgggtg
421 atcaaggccg accgggtgat cggcgacaag tggctggtca ccgaaggcct gaacgccggc
481 gacaagatca ttaccgaagg cctgcagttc gtgcagccgg gtgtcgaggt gaagaccgtg
541 ccggcgaaga atgtcgcgtc cgcgcagaag gccgacgccg ctccggcgaa aaccgacagc
601 aagggctgat caaggggatt cgtaatgtcg aagttttca  ttgataggcc cattttcgcg
661 tgggtgatcg ccttggtgat catgctcgcg ggcggcctgt cgatcctcaa tctgccggtc
721 aaccagtacc cggccatcgc cccgccggcc atcgccgtgc aggtgagcta cccgggcgcc
781 tcggccgaga cggtgcagga caccgtggtc caggtgatcg agcagcagat gaacgggatc
841 gacaatctgc gctacatctc ctcggagagt aactccgacg gcagcatgac catcaccgtg
901 accttcgaac agggcaccga ccccgacatc gcccaggtcc aggtgcagaa caagctgcaa
961 ctggccaccc cgctgctgcc gcaggaagtg cagcgccagg ggatccgg
```

Fig. 14B

SEQ ID NO:149
 PA14 mexA

G QANAMATVQ QLDPIYVDVT QPSTALLRMR RELASGQLER AGDNAAKVSL KLEDGSQYP  LEGRLEFSE
VSVDEGTGS VTIRAVFPN PNNELLPGM FVHAQLQEG VKQKAILAP QQGVTRDLK GQATALVVN
AQNKVELRV IKADRVIGD KWLVTEGLN AGDKIITEG LQFVQPGVE VKTVPAKNV ASAQKADAA PAKTDSKG

Fig. 14C

SEQ ID NO:150
 PA14 mexB

MSKFFIDRPIFAWVIALVIMLAGGLSILNLPVNQYPAIAPPAIA
VQVSYPGASAETVQDTVVQVIEQQMNGIDNLRYISSESNSDGSMTITVTFEQGTDPDI
AQVQVQNKLQLATPLLPQEVQRQGIR

Fig. 14D

PAO1 Phenazine operon SEQ ID NO:114

```
   1 GCAAGCTCAA CTCCAGCAAC AAGGCGGAGG CCACCATGAA GGCTTACGCC
  51 ATCGGCCTGC TCAACTGAAT CGACGCCTCG TCGCCTAGCG AGGCCGCCGC
 101 GCAAGCGTCC GGCCATTCAC CGAATGGCCG GATAGCGTTT GCGCCGGTCG
 151 CCTGAGCGCA CGCTTCCCAC CGGCAGCGTT TCCCCGCTGC CCCCTTCGCC
 201 ATTGCGCCCG TCCTCATGTT GTCCGGACGC TAGTCGAACT TTCCGGGCGC
 251 CTGGCAAACC GGCCAAAGAA TAGAACGGAA TCGATGCCCA CACCTTTAAT
 301 TTTTAAGGGT TTTTCCTTTT CAAAAACCGT TATTAAGTTT TCCCCTTTAA
 351 ATCTTGGTAC AACTGGGTTC AGGCGAAACT TCGGTCATGC CATTCGGCAT
 401 TAGTTAAACT TTGAGACTCT CCAAGCGGGA ATTTTGCCG GAACAGCTTC
 451 ACGGCATTTC TCCGCTTTCA TCCCGATGTT CTTTCCGTT ATGATTCCAG
 501 TCGATTCGAA CTGCCGGAGT TCCCACCATT CGAGATTACC AACGTTGAAA
 551 AGGGTTTACC GACAACCTGG AATTGCGTCG GCGCAACCGT GCCACGGTCG
 601 AGCACTACAT GCGCATGAAG GGGGCCGAAC GGTTACAGCG GCACAGCCTG
 651 TTCGTCGAGG AGGCTGCGCC GGCAACTGGA CCACGGAAAG CGGCGAACCC
 701 CTGGTTTTCC GGGGCCATGA GAGCCTCAGG CGGCTCGCCG AGTGGCTCGA
 751 GCGCTGCTTC CCCGACTGGG AGTGGCACAA CGTGCGGATC TTCGAGACCG
 801 AGGATCCGAA CCACTTCTGG GTCGAGTGCG ACGGGCGCGG CAAGGCGCTG
 851 GTCCCGGGGT ATCCGCAGGG CTATTGCGAG AACCACTACA TCCATTCCTT
 901 CGAACTCGAG AACGGCCGGA TAAAACGCAA TCGCGAGTTC ATGAACCCGA
1001 TGCAGAAATT GCGTGCATTG GAATAGCCG TTCCACAAAT AAAACGTGAC
1051 GGTATTCCCA CCTGATTAAT GTCTATTCCA ATTCAAGAGG AGATATGACG
1101 ATGCTCGATA ATGCCATTCC TCAAGGTTTC GAAGACGCCG TGGAGTTGCG
1151 CAGGAAGAAT CGCGAGACGG TGGTCAAGTA TATGAACACC AAAGGCCAGG
1201 ATCGCCTGCG CCGCCATGAA CTTTTCGTCG AGGACGGCTG TGGCGGTTTA
1251 TGGACCACCG ATACCGGCTC GCCCATCGTC ATTCGTGGCA AGGACAAGCT
1301 GGCCGAGCAC GCGGTGTGGT CGCTGAAATG CTTCCCGGAT GGGAGTGGT
1351 ACAACATCAA GGTCTTCGAG ACCGACGATC CCAACCACTT CTGGGTCGAG
1401 TGCGACGGCC ACGGCAAGAT CCTCTTCCCC GGCTATCCCG AGGGCTACTA
1451 CGAGAACCAC TTCCTGCATT CCTTCGAGCT GGACGACGGC AAGATCAAGC
1501 GCAACCGCGA ATTCATGAAC GTCTTCCAGC AATTGCGCGC CCTGAGCATT
1551 CCGGTCCCGC AGATCAAACG CGAAGGCATT CCCACCTGAG GCCATCCTGG
1601 AAGGGGTGAA CTATGGACGA TCTATTGCAA CGCGTACGGC GCTGCGAAGC
1651 GCTGCAGCAA CCCGAATGGG GCGATCCGTC GCGCCTGCGC GACGTGCAGG
1701 CGTACCTGCG CGGCAGTCCG GCGCTGATCC GCGCCGGCGA CATCCTGGCC
1751 CTGCGCGCGA CCCTGGCGCG GGTCGCCCGC GGCGAGGCGC TGGTGGTGCA
1801 GTGCGGCGAC TGCGCCGAGG ACATGGACGA CCACCATGCC GAGAACGTGG
1851 CGCGCAAGGC CGCCGTGCTG GAACTGCTGG CCGGCGCCCT GCGCCTGGCC
1901 GGCCGGCGGC CGATAGATCC GCGTCGGGCG CATCGCCGGG CAGTACGCCA
1951 AGCCGCGTTC CAAGCCGCAC GAGCAGGTCG GCGAGCAGAC CCTGCCGGTC
2001 TATCGCGGCG ACATGGTCAA CGGCCGCGAG GCCCATGCCG AACAGCGCCG
2051 GGCCGATCCG CAGCGGATCC TCAAGGGCTA TGCGGCGGCG CGCAACATCA
2101 T
```

Fig. 15

3E8 sequence  SEQ ID NO:115

```
   1 CGGCGCCGAG GATCCGCTGT TCGAGTTAGG CGCAAGCGTC CGGCCATTCA
  51 CGGAATGGCC GGATAGCGTT TGCGCCGGTT GCTTGAGCGC AGCTTCCCAC
 101 CGGCAGGGTT TCCCCGCTGC CCCTTTCGCC ATTGCGCCGT CCTCTTGTTG
 151 TCCGGCACGC TAGTGCAACT TTCCGGACGC TTGGCAAACC GGCCAAAGAA
 201 TAGAACGGAA TCGATGCCCC ACACCTGTAA TTTTTAAGGG GTTATGGCTA
 251 TTGCAAAAAA GCGTTTATAA GTTTGTCCCC TGTCAAATCT GGTTACAACT
 301 GGGTTTCAGG CGAAACATTC GGTCATGGCA ATTCGGCATT AGTTGAAACT
 351 TTGGAGACGC TCCGAAGCGG GCAACTTTTG CCCGGAAAAA GTTTCACGGC
 401 AATTTTTCCG GCCTGTCATC CCGATGTCTT CTTTCCAGTA TGGATGCCAG
 451 TCGATTCGAA CTGGCGGAGA TTCGCACCAT GCGAGAGTAC CAACGGTTGA
 501 AAGGGTTTAC CGACAACCTG GAATTGCGGC GGCGCAACCG TGCCACGGTC
 551 GAGCACTACA TGCGCATGAA GGGGGCCGAA CGGTTGCAGC GGCACAGCCT
 601 GTTCGTCGAG GACGGCTGCG CCGGCAACTG GACCACGGAA AGCGGCGAAC
 651 CCCTGGTTTT CCGGGGCCAT GAGAGCCTCA GGCGGCTCGC CGAGTGGCTC
 701 GAGCGCTGCT TCCCCGACTG GGAGTGGCAC AACGTGCGGA TCTTCGAGAC
 751 CGAGGATCCG AACCACCTCT GGGTCGAGTG CGACGGGCGC GGCAAGGCGC
 801 TGGTCCCGGG GTATCCGCAG GGCTATTGCG AGAACCACTA CATCCATTCC
 851 TTCGAACTCG AGAACGGCCG GATAAAACGC AATCGCGAGT TCACGAACCC
 901 GATGCAGAAA TTGCGTGCAT GGGAATAGC  CGTTCCGCAA ATAAaACGTG
 951 ACGGCATTCC CACCTGATTA ATGATTATTC CAATTCAAGA GGAGATATGA
1001 CGATGCTCGA TAATGCTATT CCCCAAGGTT TCGAAGACGC CGTGGAGTTG
1051 CGCAGGAAGA ATCGCGAGAC GGTGGTCAAG TATATGAACA CCAAAGGCCA
1101 GGATCGCCTG CGCCGCCATG AACTTTTCGT CGAGGACGGC TGTGGCGGTT
1151 TATGGACCAC CGATACCGGC TCGCCCATCG TCATTCGTGG CAAGGACAAG
1201 CTGGCCGAGC ACGCGGTGTG GTCGCTGAAA TGCCTTCCCG GATTGGGAGT
1251 GGTACAACAT CAAGGT
```

Fig. 16A

3E8 SEQUENCE TAG SEQ ID NO:160

```
   1 tatggatgcc agtcgattcg aactggcgga gattcgcacc atgcgagagt accaacggtt
  61 gaaagggttt accgacaacc tggaattgcg gcggcgcaac cgtgccacgg tcgagcacta
 121 catgcgcatg aaggggggccg aacggttgca gcggcacagc ctgttcgtcg aggacggctg
 181 cgccggcaac tggaccacgg aaagcggcga acccctggtt ttccggggcc atgagagcct
 241 caggcggctc gccgagtggc tcgagcgctg cttcccccgac tgggagtggc acaacgtgcg
 301 gatcttcgag accgaggatc cgaaccacct ctgggtcgag tgcgacgggc gcggcaaggc
 361 gctggtcccg gggtatccgc agggctattg cgagaaccac tacatccatt ccttcgaact
 421 cgagaacggc cggataaaac gcaatcgcga gttcacgaac ccgatgcaga aattgcgtgc
 481 attgggaata gccgttccgc aaataaaacg tgacggcatt cccacctgat taatgattat
 541 tccaattcaa gaggagatat gacgatgctc gataatgcta ttccccaagg tttcgaagac
 601 gccgtggagt tgcgcaggaa gaatcgcgag acggtggtca agtatatgaa caccaaaggc
 661 caggatcgcc tgcgccgcca tgaacttttc gtcgaggacg gctgtggcgg tttatggacc
 721 accgataccg gctcgcccat cgtcattcgt ggcaaggaca agctggccga gcacgcggtg
 781 tggtcgctga aatgcttccc ggattgggag tggtacaaca tcaaggtctt cgagaccgac
 841 gatcccaacc acttctgggt cgagtgcgac ggccacggca agatcctctt ccccgggtat
 901 cccgagggtt actacgagaa ccacttcctg cattccttcg agctggacga cggcaagatc
 961 aagcgcaacc gcgaattcat gaacgtcttc cagcaattgc gcgccctgag cattccggtc
1021 ccgcagatca aacgcgaagg cattcccacc tgaggccatc ctggaagggg tgaactatgg
1081 acgatctatt gcaacgcgta cggcgctgcg aagcgctgca gcaacccgaa tggggcgatc
1141 cgtcgcgcct gcgcgacgtg caggcgtacc tgcgcggcag tccggcgctg atccgcgccg
1201 gcgacatcct ggccctgcgc gcgaccctgg ccgggtcgcc cgcggcgagg cgctggtggt
1261 gcagtgcggc gactgcgccg aggacatgga cgaccacca
```

Fig. 16B

3E8 phzA   SEQ ID NO:116

```
  1 MREYQRLKGF TDNLELRRRG SAVRVRRKRP AIHGMAGZRL RRLLERSFPP
 51 AGFPRCPFRH CAVLLLSGTL VQLSGRLANR PKNRTESMPH TCNFZGVMAI
101 AKKRLZVCPL SNLVTTGFQA KHSVMAIRHZ LKLWRRSEAG NFCPEKVSRQ
151 FFRPVIPMSS FQYGCQSIRT GGDSHHARVP TVERFTDNLE LRRRNRATVE
201 HYMRMKGAER LQRHSLFVED GCAGNWTTES GEPLVFRGHE SLRRLAEWLE
251 RCFPDWEWHN VRIFETEDPN HLWVECDGRG KALVPGYPQG YCENHYIHSF
301 ELENGRIKRN REFTNPMQKL RALGIAVPQI KRDGIPTZLM IIPIQEEIZR
351 CSIMLFPKVS KTPWSCAGRI ARRWSSIZTP KARIACAAMN FSSRTAVAVY
401 GPPIPARPSS FVARTSWPST RCGRZNAFPD WEWYNIK
```

Fig. 17

3E8 phzB SEQ ID NO:117

```
 1 MLDNAIPQGF EDAVELRRKN RETVVKYMNT KGQDRLRRHE LFVEDGCGGL
51 WTTDTGSPIV IRGKDKLAEH AVWSLKCLPG LGVVQHQG
```

Fig. 18A

3E8 PHZA SEQ ID NO:161

MREYQRLKGFTDNLELRRRNRATVEHYMRMKGAERLQRHSLFVE
DGCAGNWTTESGEPLVFRGHESLRRLAEWLERCFPDWEWHNVRIFETEDPNHLWVECD
GRGKALVPGYPQGYCENHYIHSFELENGRIKRNREFTNPMQKLRALGIAVPQIKRDGIPT

Fig. 18B

PhzB SEQ ID NO:162

MLDNAIPQGFEDAVELRRKNRETVVKYMNTKGQDRLRRHELFVEDGCGGLWTTDTGSPIVIRGKDKLAEHAVWSLKCF
PDWEWYNIKVFETDDPNHFWVECDGHGKILFPGYPEGYYENHFLHSFELDDGKIKRNREFMNVFQQLRALSIPVPQIK
REGIPT

Fig. 18C

PhzC SEQ ID NO:163

MDDLLQRVRRCEALQQPEWGDPSRLRDVQAYLRGSPALIRAGDILALRATLAGSPAARRWWCSAATAPRTWTTT

Fig. 18D

PA14 phzR SEQ ID NO:164 phzR DNA sequence : 1161 bp

CGTCGACGAGGCCCGC CATGGGCCAAGGTTTGTTGT CGGGAGGCgCTCCCGACGACGATG
GAGCGTGCGAGAAGAACAATGAGAAAGACCGCCGTGAGGCCCATCGGAGAGCCGTTCTAC
GGTTTCCGCAAAGATCCGGGGCGCCGTCCCCTCCAGCa CAGCGCAGTTCCTGCGCGGCGC
CTCGTGTCCGTGCTCATCGAGAAGTTCTCTTCAGCCTCGTTTCGTCGTCGCCCGGCGGGC
GGCGAATGGGCTCGACCTCGTCCGGAACACCCGCACAGGGCCGGTGGCGATATGTACTTC
CAGGTCCGGCTTGATAAAGGGAATTGTCATGAGTGGATAAGACGGAAACAAAAAAGAATA
AAAACGCTGAAGAACCGAATCCTGCCGGGATCGATTGTTGACTGGTGAAGCTGGCATGCA
TGATGAGAGAGAGGGATATCTCGAGATTTTGTCAAGAATAACAACCGAGGAAGAGTTCTT
CTCCCTGGTTCTCGAGATATGCGGTAATTATGGATTCGAATTCTTTTCATTCGGTGCGCG
GGCGCCTTTCCCGCTGACCGCGCCTAAATATCATTTCCTGTCCAATTACCCAGGGGAATG
GAAAAGCAGATATATCTCCGAAGACTACACATCCATCGACCCGATCGTGCGCCATGGTCT
CCTGGAATACACCCCGCTGATCTGGAATGGCGAAGACTTCCAGGAGAACCGTTTCTTCTG
GGAGGAAGCGCTGCATCACGGCATCCGTCACGGCTGGTCGATCCCGGTCCGCGGCAAGTA
CGGGCTGATCAGCATGCTGTCCCTGGTGCGTTCCAGCGAGAGCATCGCCGCTACGGAAAT
CCTGGAGAAGGAATCCTTCCTGCTCTGGATCACCAGCATGCTGCAGGCTACCTTCGGCGA
CCTGCTGGCGCCGCGCATCGTCCCGGAAAGCAATGTGCGCCTGACCGCCAGGGAAACCGA
GATGCTCAAGTGGACCGCGGTGGGCAAGACCTACGGCGAGATCGGCCTGATCCTGTCGAT
CGACCAGCGCACGGTGAAATTCCATATCGTCAATGCGATGCGCAAGCTCAACTCCAGCAA
CAAGGCGGAGGCCACCATGAAGGCCTACGCCATCGGCCTGCTCAACTGAATCGACGCCTC
GTCGCCTAGCGAGGCCGCCGC

Fig. 18E

PA14 PhzR SEQ ID NO:165

PhzR peptide sequence

MHDEREGYLEILSRITTEEEFFSLVLEICGNYGFEFFSFGARAPFPLTAPKYHFLSNYPG
EWKSRYISEDYTSIDPIVRHGLLEYTPLIWNGEDFQENRFFWEEALHHGIRHGWSIPVRG
KYGLISMLSLVRSSESIAATEILEKESFLLWITSMLQATFGDLLAPRIVPESNVRLTARE
TEMLKWTAVGKTYGEIGLILSIDQRTVKFHIVNAMRKLNSSNKAEATMKAYAIGLLNZ

Fig. 18F

34H4 SEQ ID NO:118

```
  1 ACCAACATCC TGGTCCTGAG CAACAGCCAG CGCCACGGCC TGGCCGCCGC
 51 CTGGCCGATC GTGCTCGGCG CCTGCGCGGC GGTGGCGGCG CTGATCCTGC
101 TGCTCGGGCT CGGCCTGGGC GAGCTGCTGC GGCGCCACCC GTTGCTCCAG
151 CAGGGGCTCG CCTGGCTTGG CGTCGGCTGG CTCAGCTACC TGGCCTGGAG
201 CCTGTTCCGC AGCGCG
```

Fig. 19

33C7 SEQ ID NO:119

```
  1 CCACCGAAGT AACGGGTCAG CTCGTCGCAC AACAGGCGTC GCTCCTCGGC
 51 CTGCATCAGG CTGCCCAGCG GGCCCTGGAA CCAGTCGCGC GCGCCCGGTT
101 GAT
```

Fig. 20

25a12.3 SEQ ID NO:120

```
  1 GCGGTGCCCT GGATGTCGTC GTTGAAGCAG CACAGCTCGT CCTTGTAGCG
 51 CTCCAGCAAC GGCATGGCAT TGGTCTGGGC GAAGTCCTCG AATTGCAGCA
101 GGACCTTGGG CCACGGCGCT TGATCGCCTG GATGAACAGG TCGACAA
```

Fig. 21

8C12 SEQ ID NO:121

```
  1 TATTTGTGTA TAAGNCTCAG GcTCtGGAGG GGCCGCTGGG CAGGCNNAAC
 51 NNCCTCGCGT NCTNGGCGAC GANTTNCNNA TGCTTCGCNT GCTGCCGGCG
101 TCTCNNCCCT CNGTACTAgT CTACGCGTGG ACAACGTGGC
```

Fig. 22

2A8 SEQ ID NO:122

```
  1 NATTTGTGTA TAAGAGTCAG GATCGAACGC TTCTCTTCGC CGCAGGAAAG
 51 CCACCGCCGA GCTGCTGAAG ATGCTCGAGC GCAAGGGACA AGATCATGGG
101 CTTCGGGCAT NCCNTCTNNA TCGATTCCTN CCCACGCAAC GAAgTGATCA
151 AGGGTTGGTC GAAGCAGCTC GCCGACgAGG TCGGCGACAA GGTCCTGTTC
201 GCGGTTTCCG AGGCCATCGA CAAGACCATG TGGGAGCAGA AGAACTGTTC
251 CCCAACGCCG ACTTCTACCA CGCCTCGGCG TCNCCNTCC NGTGCTTCCA
301 CCTT
```

Fig. 23

41A5 SEQ ID NO:123
```
  1 tcgttgtaca ggccgaacag gccgagctgc caggtgtcgc cctcg
```

Fig. 24A

50E12 SEQ ID NO: 124
```
  1 gagcagacct gggtacccat ggcttccttg acccgctgca cgatgatgcc cagcgccgcc
 61 ttcagatcct tggcggagtt ctcttcctgg acgatcttgc gcagcgtgtt gagcatgctc
121 ggggccttgt ctccgtgttc agtcccgcgc cagaaggcgc ggggccagtt ccttcagggc
181 gcggcggtag acctcgcgct tgaaggtcac cacctgtccc aggggtacc agtaactcac
241 ccagcgccag ccgtcgaact cgggcttgct ggtgatatcc atgcgcacgc gcgcctcgtc
301 ggacatcagc cgcagcagga accatttctg cttctggccg atgcacagcg gctggctgtg
361 ggtccgcacc aggcgctgcg gcaaacggta gcgcagccag ccgcgg
```

Fig. 24B

35A9 SEQ ID NO: 125
```
  1 cgcgacagta gcatataatc aatcatgagt gattaattaa ttggcgtttc tgtaacatat
 61 ccttatgatc tgcggcgcct ttccttgtg aggacgttca gtggccagga aaaccaaaga
121 ggaatcccag aaaacccgcg acggcatact cgatgccgcc gagcgggttt cctggaaaa
181 gggcgtgggc accactgcca
```

Fig. 24C pho23 SEQ ID NO: 126
```
  1 tcgatcccaa tgactacaag gacgaaatcc gccagatcgc ccgcgacaag gccaacctgg
 61 agctggacct gaagggcgac atcggctgga gcctgttccc ctggctgggc ctggagc
```

Fig. 24D

6G12 SEQ ID NO: 127
```
  1 ggataggtgc ggcggaaaac gtacgggacg aaagagcggt tttcccgaat gacgcatcct
 61 cctgcaagcg caacttgctg gtggtcgata gcaagtaagg cgcgagacat gtcctgaact
121 tcatggggc ttttcttat agggcggact gtcgattctg ctagctggta atccttcttt
181 tattgtctct gtgtgcgctt tttgtatgga tgtgtcgaat attttgaata tcgccgttca
241 actttatcca gggccgcagt tcagtgattt attttctcga aagtttgtt ttttccaata
301 ttcatgcttc atagtctggc cggcc
```

Fig. 24E

25F1 SEQ ID NO: 128
```
  1 gcaggaaacc gttctccana tcctgggcga gaatcctcgg cacatgcacg ccggctccgg
 61 cgagcagtcc ggcgaccttg acgaacggtc ggcagtcttc ctggggcggc ggcgcgtcca
121 tcaccaccag gctgcggtcc cctccctgcc agcggaaata cgacggaag ctggcgtcgc
181 tactggccgg gatcagttcg gcggggggca cttccccca accttcggca acgaacaact
241 cgggcaaaca agagtccaac cagcaattca gctgctggaa acgggcatca tcagacattt
301 acggggttct ccacggccct agccgttgcg caggtcatgc tttattatcc agcatctttt
```

Fig. 24F

```
1/1                                                            31/11                                                          61/21                                                          91/31
atg cgt aac ctg att ctc acc gcc atg agc ctg ttc ggc atg gcc atg gcc ctg ttc ggc atg gcc cag gcc gac gac tat acc gcc ggc aag gaa tac gtc gag ctg agc ccg gtg gtg ccg gtg
 M   R   N   L   I   L   T   A   M   S   L   F   G   M   A   M   A   Q   A   D   D   Y   T   A   G   K   E   Y   V   E   L   S   P   V   V   P   V 121/41                                                         151/51                                                         181/61                                                         211/71
tcc cag ccg ggc aag atc gaa gtg gaa ctg ttc tgg tat ggc ttc tgc ccg cat tgc tac gcg ttc gag ccg acc atc gtg ccg tgg agc gag aag ctg ccg gca gat gtc cat ttc gtg
 S   Q   P   G   K   I   E   V   E   L   F   W   Y   G   F   C   P   H   C   Y   A   F   E   P   T   I   V   P   W   S   E   K   L   P   A   D   V   H   F   V 241/81                                                         271/91                                                         301/101                                                        331/111
cgc ctg cct gcc ctg ggt atc tgg aac cat ggg cag atg ttc ctg acc ctg gaa agc atg ggt gtc gag cat gac gtC cac aac gcc gtg ttc gag gcg atc cac aag gag
 R   L   P   A   L   G   I   W   N   H   G   Q   M   F   L   T   L   E   S   M   G   V   E   H   D   V   H   N   A   V   F   E   A   I   H   K   E 361/121                                                        391/131                                                        421/141                                                        451/151
cac aag ctc gcc act ccg gaa gaG atg gcc gat ttc ctc ggc aag ggc gtg gac aag gag aaa ttc gcc atc tcc tat aat tcc ttt gcc atc aag ggc cag atg gaa aag gcc
 H   K   L   A   T   P   E   E   M   A   D   F   L   G   K   G   V   D   K   E   K   F   A   I   S   Y   N   S   F   A   I   K   G   Q   M   E   K   A 481/161                                                        511/171                                                        541/181                                                        571/191
aag cag ctg gcg atg gcc tac cag gcc acc ggc gta ccg acc atg gtg gtc aat ggc aaa tac cgc ttc gac atc ggc tcc gcc ggt ggt ccg gag gaa acc ctc aag ctg gcc gac tac
 K   Q   L   A   M   A   Y   Q   A   T   G   V   P   T   M   V   V   N   G   K   Y   R   F   D   I   G   S   A   G   G   P   E   E   T   L   K   L   A   D   Y 601/201
ctg atc gag aaa gag cgc gcg gcc aag aag tag
 L   I   E   K   E   R   A   A   K   K   *
```

Fig. 24G

Sequences of PA14 50E12 encoding for YgdPPa and PtsPpa

```
1/1                              31/11                          61/21                           91/31
GAA AAG GGC CAG ACG CAC GGG GTG ACT CCA TCG GTT GGC GGG TGG CGG gAG GGC CGC GAG AGC CTT TTG CGA AGG CTC CCA CCG GGC CTT GGG AAA aCC CCT AGC CTA CCG GCT TTT GCC

121/41                           151/51                         181/61                          211/71
GGC CCT GTA TCC TCC CCG CAC GAG TCG CAA AGC CGC GCG TTG CCG CTA TCA CAA GCT TTA TGG AAC AAT GCG GGC ACA TGC GAT TTC GAG GAT GTC CCA GCG TGA TCG ATT CCG ATG GTT
                                                                                                                                          M   I   D   S   D   G   F
241/81                           271/91                         301/101                         331/111
TTC GCC CGA ATG TCG GCA TCA TTC TCG CCA ACG AGG CGG GGC AGG TGC TGT GGG CGC GGC GTA TCA ATC AGG AAG CCT GGC AGT TCC CGC AGG GAG GCA TCA ATG ATC GCG AAA CGC CGG
 R   P   N   V   G   I   I   L   A   N   E   A   G   Q   V   L   W   A   R   R   I   N   Q   E   A   W   Q   F   P   Q   G   G   I   N   D   R   E   T   P   E

361/121                          391/131                        421/141                         451/151
AAG AGG CGC TGT ATC GCG AaT GAA ACG AAG AAG TCG GGC TGG AGG CCG GGG ACG TGC GCA TCC TGG CCT GCA CCC GCG GCT GGc TGC GCT ACC GTT GCC CAG CGC CTG TGC GGA CCC
 E   A   L   Y   R   E   L   N   E   E   V   G   L   E   A   G   D   V   R   I   L   A   C   T   R   G   W   L   R   Y   R   L   P   Q   R   L   V   R   T   H

481/161                          511/171                        541/181                         571/191
ACA GCC AGC CGC TGT GCA TCG GCC AGA AGC AGA AAT GGT TCC TGC TGC GGC TGA TGT CCG ACG AGG CGC GCG TGC GCA TGG ATA TCA CCA GCA AGC CCG AGT TCG ACG GcT GGC GCT GGG
 S   Q   P   L   C   I   G   Q   K   Q   K   W   F   L   L   R   L   M   S   D   E   A   R   V   R   M   D   I   T   S   K   P   E   F   D   G   W   R   W   V

601/201                          631/211                        661/221                         691/231
TGA GTT ACT GGT ACC CCC TGG GAC AGG TGG TGA CCT TCA AGC GCG AGG TCT ACC GCC GCG CCC TGA AGg AAC TGG CcC CGc GCC TTC TGG CGC GGG ACT GAA CAC GGA GAC AAG GCC CCG
 S   Y   W   Y   P   L   G   Q   V   V   T   F   K   R   E   V   Y   R   R   A   L   K   E   L   A   P   R   L   L   A   R   D   *

721/241                          751/251                        781/261                         811/271
AGC ATG CTC AAC ACG CTG CGC AAG ATC GTC CAG GAA GTG AAC TCC GCC AAG GAT CTG AAG GCG GCG CTG GGC ATC ATC GTG CAG CGG GTC AAG GAA GCC ATG GGT ACC CAG GTC TGC TCG
   M   L   N   T   L   R   K   I   V   Q   E   V   N   S   A   K   D   L   K   A   A   L   G   I   I   V   Q   R   V   K   E   A   M   G   T   Q   V   C   S

841/281                          871/291                        901/301                         931/311
GTG TAC CTG CTC GAC ACC GAG ACC CAG CGT TTC GTC CTG ATG GCC ACC GAA GGC CTC AAC AAG CGT TCC ATC GGC AAG GTC AGC ATG GCc CCC AGC GAA GGC CTG GTC GGC CTG GTC GGC
 V   Y   L   L   D   T   E   T   Q   R   F   V   L   M   A   T   E   G   L   N   K   R   S   I   G   K   V   S   M   A   P   S   E   G   L   V   G   L   V   G

961/321                          991/331                        1021/341                        1051/351
ACC CGC GAG GAG CCG CTC AAC CTG GAG AAC GCC GCC GCC CAC CCG CGC TAC CGC TAT TTC GCC GAG ACC GGC GAG GAG CGC TAC GCG TCG TTC CTC GGC GCG CCG ATC ATC CAC CAT aGG
 T   R   E   E   P   L   N   L   E   N   A   A   A   H   P   R   Y   R   Y   F   A   E   T   G   E   E   R   Y   A   S   F   L   G   A   P   I   I   H   H   R

1081/361                         1111/371                       1141/381                        1171/391
CGG GTG ATG GGG GTG CTG GTG GTG CAG CAG AAG GAG CGC CGC CAG TTC GAC GAA GGC GAG GAg GCC TTC CTC GTC ACC ATG AGC GCC CAG CTC GCC GGG GTC ATC GCG CAT GCC GAG GCG
 R   V   M   G   V   L   V   V   Q   Q   K   E   R   R   Q   F   D   E   G   E   E   A   F   L   V   T   M   S   A   Q   L   A   G   V   I   A   H   A   E   A

1201/401                         1231/411                       1261/421                        1291/431
ACC GGT TCG ATC CGC GGC CTG GGC AAG CTC GGC AAG GGC ATC CAG GAA GCC AAG TTC GTC GGC GTG CCC GGC GCC CCC GGG GTC GGG GTG GGC AAG GCG GTG GTG GTG TTG CCt CCG GCC
 T   G   S   I   R   G   L   G   K   L   G   K   G   I   Q   E   A   K   F   V   G   V   P   G   A   P   G   V   G   V   G   K   A   V   V   V   L   P   P   A

1321/441                         1351/451                       1381/461                        1411/471
GAC CTG GAA GTG GTG CCG GAC AAG CAG GTC GAC GAC ATC GAC GCC GAG ATC GCC CTG TTC AAG CAG GCC CTG GAG GGC GTT CGC GCC GAC ATG CGC GCG CTG TCG AGC AAG CTC GCC AGC
 D   L   E   V   V   P   D   K   Q   V   D   D   I   D   A   E   I   A   L   F   K   Q   A   L   E   G   V   R   A   D   M   R   A   L   S   S   K   L   A   S

1441/481                         1471/491                       1501/501                        1531/511
CAG tTG CGC AAG GAA GAA CGC GCG CTG TTC GAC GTC TAC CTG ATG ATG CTC GAC GAT GCC TCC ATC GGC AAC GAG GTC AAG CGC ATC ATC CGT ACC GGC CAG TGG GCC CAG GGC GCC CTG
 Q   L   R   K   E   E   R   A   L   F   D   V   Y   L   M   M   L   D   D   A   S   I   G   N   E   V   K   R   I   I   R   T   G   Q   W   A   Q   G   A   L

1561/521                         1591/531                       1621/541                        1651/551
CGC CAG GTG GTG ATG GAG CAC GTG CAG CGC TTC GAG CTG ATG GAC GAC GCC TAT CTC CGC GAG CGC GCC TCC GAC GTC AAG GAC ATc GGT CGC CGC CTG CTC GCC TAC CTg CAG GAA GAa
 R   Q   V   V   M   E   H   V   Q   R   F   E   L   M   D   D   A   Y   L   R   E   R   A   S   D   V   K   D   I   G   R   R   L   L   A   Y   L   Q   E   E

1681/561                         1711/571                       1741/581                        1771/591
CGC AAG CAG AAC CTG ACC TAC CCG GAg CAG ACC ATC ATC GTC AGC GAG GAG CTG TCG CCG GCG ATG CTC GGC GAG GTG CCG GAA GGG CGC CTG GTC GGC CTG GTC TCG GTG CTC GGC TCG
 R   K   Q   N   L   T   Y   P   E   Q   T   I   I   V   S   E   E   L   S   P   A   M   L   G   E   V   P   E   G   R   L   V   G   L   V   S   V   L   G   S

1801/601                         1831/611                       1861/621                        1891/631
GGC AAC TCG CAC GTG GCG ATC CTC GCC CGT GCC ATG GGC ATC CCC ACG GTG ATG GGG GCG GTC GAC CTG CCG TAC TCC AAG GTC GAC GGt ATC GAC CTG ATC GTC GAT GGC TAC CAC GGC
 G   N   S   H   V   A   I   L   A   R   A   M   G   I   P   T   V   M   G   A   V   D   L   P   Y   S   K   V   D   G   I   D   L   I   V   D   G   Y   H   G
```

Fig. 24H

```
1921/641                    1951/651                    1981/661                    2011/671
GAG GTC TAC ACC AAC CCC TCC GCC GAG CTG GTG CGC CAG TAC AGC GAC GTG GTC GCC GAG GAG CGC GAG CTG AGC AAG GGC CTG GCG GCC CTG CGC GAG CTG CCC TGC GAG ACC CTC GAC
 E   V   Y   T   N   P   S   A   E   L   V   R   Q   Y   S   D   V   V   A   E   E   R   E   L   S   K   G   L   A   A   L   R   E   L   P   C   E   T   L   D

2041/681                    2071/691                    2101/701                    2131/711
GGC CAC CGC ATG CCG CTC TGG GTC AAC ACC GGC CTG CTC GCC GAT GTC GCC CGC GCC CAG GAG CGT GGC GCC GAG GGC GTG GGC CTG TAC CGC ACC GAA GTG CCG TTC ATG ATC AAC GAC
 G   H   R   M   P   L   W   V   N   T   G   L   L   A   D   V   A   R   A   Q   E   R   G   A   E   G   V   G   L   Y   R   T   E   V   P   F   M   I   N   D

2161/721                    2191/731                    2221/741                    2251/751
CGC TTC CCC AGC GAG AAG GAA CAG cTG GCG ATC TAC CGC GAG CAG CTC AGT GCC TTC CAC CCG CTG CCG GTG ACC ATG CGC ACC CTG GAT ATC GGC GGC GAC AAG GCG CTG TCC TAC TTC
 R   F   P   S   E   K   E   Q   L   A   I   Y   R   E   Q   L   S   A   F   H   P   L   P   V   T   M   R   T   L   D   I   G   G   D   K   A   L   S   Y   F

2281/761                    2311/771                    2341/781                    2371/791
CCG ATC AAG GAA GAC AAC CCG TTC CTC GGc TGG CGC GGC ATC CGC GTC ACC CTC GAC CAC CCG GAG ATC TTC CTG GTC CAG ACC CGC GCC ATG CTC AAG GCC AGC GAA GGA CTG GAC AAC
 P   I   K   E   D   N   P   F   L   G   W   R   G   I   R   V   T   L   D   H   P   E   I   F   L   V   Q   T   R   A   M   L   K   A   S   E   G   L   D   N

2401/801                    2431/811                    2461/821                    2491/831
CTG CGC ATC CTG CTG CCG ATG ATC TCC GGC ACC CAC GAG CTG GAA GAG GCC CTG CAC CTG ATC CAC CGC GCC TGG GGC GAG GTG CGC GAC GAG GGC GTG GAC ATC GCC ATG CCG CCt ATC
 L   R   I   L   L   P   M   I   S   G   T   H   E   L   E   E   A   L   H   L   I   H   R   A   W   G   E   V   R   D   E   G   V   D   I   A   M   P   P   I

2521/841                    2551/851                    2581/861                    2611/871
GGC ATG ATG GTC GAG ATT CCC GCC GCC GTG TAC CAG ACC CGC GAG CTG GCC CGt CAG GTC GAC TTC CTT TCG GTC GGT TCG AAC GAC CTG ACC CAG TAC CTG CTG GCG GTC GAC CGC AAC
 G   M   M   V   E   I   P   A   A   V   Y   Q   T   R   E   L   A   R   Q   V   D   F   L   S   V   G   S   N   D   L   T   Q   Y   L   L   A   V   D   R   N

2641/881                    2671/891                    2701/901                    2731/911
AAT CCG CGG GTC GCC GAC CTC TAC GAC TAC CTG CAT CCG GCC GTg CTG CAT GCG TTG AAG AAG GTG GTC GAC GAT GCC CAC CTG GAA GGC AAG CCG GTG AGC ATC TGC GGC GAG ATG GCC
 N   P   R   V   A   D   L   Y   D   Y   L   H   P   A   V   L   H   A   L   K   K   V   V   D   D   A   H   L   E   G   K   P   V   S   I   C   G   E   M   A

2761/921                    2791/931                    2821/941                    2851/951
GGC GAT CCC GCG GCT GCC GTG CTG CTG ATG GCG ATG GGC TTC GAC AGC CTG TCG ATG AAC GCC ACC AAC CTG CCC AAG GTG AAG TGG CTG CTG CGC CAG ATC ACC CTG GAC AAG GCC CGG
 G   D   P   A   A   A   V   L   L   M   A   M   G   F   D   S   L   S   M   N   A   T   N   L   P   K   V   K   W   L   L   R   Q   I   T   L   D   K   A   R

2881/961                    2911/971                    2941/981                    2971/991
GAC CTG CTC GGC CAG TTG CTC ACC TTC GAC AAC CCG CAG GTC ATC CAC AGC TCG CTG CAC CTG GCG TTG CGC AAC CTC GGC CTG GGT CGC GTG ATC AAC CCG GCG GCT ACC GTC CAG CCC
 D   L   L   G   Q   L   L   T   F   D   N   P   Q   V   I   H   S   S   L   H   L   A   L   R   N   L   G   L   G   R   V   I   N   P   A   A   T   V   Q   P

3001/1001
TGA TTT TCC C
 *
```

Fig. 24I

Sequence of PA14 35A9 encoding mtrRPa

```
1/1                              31/11                           61/21                           91/31
GTC GAT TTG GAA CAG CAC GGT GCC GGC GCG GAC TgC CTG GCC TTC CTC GTA CAG GCG ACG GGT GAC GAT GCC GGC GAC GCG CGC CCG CgC cTC gGC CTG GCG GTA CGC TTC CAG GCG TCC

121/41                           151/51                          181/61                          211/71
GGG CAG CTC GCT GGT GAT GCC GAT gGG CGC CGG CCT GGC GAC GAT CAC GCC GAC CTC GGC GGG GGC CTC CGC AGT CTT CCC GGt GTC CGC TGC TTC TTC GCA GCC CAG CAG GAA TAG GGC

241/81                           271/91                          301/101                         331/111
GAC CAG GGC CGC CAG CAG CCC GCG CAG CGA GCC GGT CCA TTG GAT GTG CAT GGG TGT CCC TCG ATT CGT GAA CTC GCG AGC TTG CCC GGG AAg GGG CAC CGC AAC TCA CGA GCG GCG CGA

361/121                          391/131                         421/141                         451/151
CAG TAG CAT ATA ATC AAT CAT GAG TGA cTA ATT AAT TGG CGT TTC TGT AAC ATA TCC TTA TGA TCT GCG GCG CCT TTC CCT TGT GAG GAC GTT CAG TGG CCA GGA AAA CCA AAG AGG AAT
                                                                                                                                   M   A   R   K   T   K   E   E   S

481/161                          511/171                         541/181                         571/191
CCC AGA AAA CCC GCG AtG GCA TAC TCG ATG CCG CCG AGC GGG TTT TCC TGG AAA AGG GCG TGG GCA CCA CTG CCA TGG CCG ACC TGG CGG ACG CCG CCG GGG TTT CTC GCG GTG CGG TCT
 Q   K   T   R   D   G   I   L   D   A   A   E   R   V   F   L   E   K   G   V   T   T   A   M   A   D   L   A   D   A   A   G   V   S   R   G   A   V   Y

601/201                          631/211                         661/221                         691/231
ACG GCC ACT ACA AGA ACA AGA TCG AGG TCT GtC TGG CGA TGT GCG ACC GCG CCT TCG GCC AGA TCG AGG TAC CCG AtG AAA ACG CCA GGG TGC CGG CGC TGG AcA TCC TCC TGC GCC CCG
 G   H   Y   K   N   K   I   E   V   C   L   A   M   C   D   R   A   F   G   Q   I   E   V   P   D   E   N   A   R   V   P   A   L   D   I   L   L   R   A   G

721/241                          751/251                         781/261                         811/271
GCA TGG GCT TTC TCC GCC AGT GCT GCG AaC CCG GTT CGG TGC AGC GGG TGC TGG AGA TCC TCT ACC TCA AGT GCG AAC GCA GCG ACG AGA ACG AGC CGC TGT TGC GCC GCC GCG AGC TGC
 M   G   F   L   R   Q   C   C   E   P   G   S   V   Q   R   V   L   E   I   L   Y   L   K   C   E   R   S   D   E   N   E   P   L   L   R   R   R   E   L   L

841/281                          871/291                         901/301                         931/311
TCG AGA AGC AGG GGC AAC GCT TCG GCC gaC GGC AGA TCC GCC GGG CGG TGG AgC GCG GCG AAC TGC CGG CGC GGC TGG ACG TCG AGC TGG CCA GCA TCT ATC TGC AAT CGC TgT GGG ACG
 E   K   Q   G   Q   R   F   G   R   R   Q   I   R   R   A   V   E   R   G   E   L   P   A   R   L   D   V   E   L   A   S   I   Y   L   Q   S   L   W   D   G

961/321                          991/331                         1021/341                        1051/351
GCA TCT GCG GCA CCC TGG CCT GGA CCG AGC GCt TGC GCG ACG ATC CCT GGA gCC GCG CCG AAC GCA TGT TCC GCG CCG GCC TCG AtA GCC TGC GCA GTT CTC CCT ACC TcT TGC TGG CGG
 I   C   G   T   L   A   W   T   E   R   L   R   D   D   P   W   S   R   A   E   R   M   F   R   A   G   L   D   S   L   R   S   S   P   Y   L   L   L   A   D

1081/361                         1111/371                        1141/381                        1171/391
ACG CCT GAG GGC GTC AAT CGT CCG CCA TCA GGT GCC TGC GCT GGT CCT CGG CGC CGG CGA CCA CCA GCC GCT GGG CGT CCT CCT CGC TGA TGT GCA GGC GCT TGC CaT CGA TGT AGA GCA
 A   *

1201/401                         1231/411                        1261/421                        1291/431
CCG ACA GGC GCG CCT CGG CGT CGG TAC CGA TGC GCA GGC TGT CGA CCG GCG CGC GAT GCC GGC TGC CTT CGA TCT CCA CGC TGC AGA tGC CTT GTT CCG AAT CGA TTT CGA TGG ACA TGG

1321/441                         1351/451                        1381/461                        1411/471
GAa CCT CCc GTT TTc TCC GCC TAC CTT GGG TGG ACC CCG GGC ATC CGC GCG GGT TCT GTC ACG GTA GCT TCA CGC CAG CGT CAC GCG CCT GCC ACC GCG CTT GGC TGC AAT CGT CCG CAG

1441/481                         1471/491                        1501/501
AGA aGG CGA GGC CAG CGG AGG ACG ACG CCA TGC GGC TAT GCG TGA TTG GTG CGG GCT ATG TGG GAC TGG TGA
```

Fig. 24J

Sequences of PA14 25F1 encoding for orfT, OrfU and DjlAPa

```
1/1                          31/11                        61/21                        91/31
CGA GGA ATC CAG TCG AGG TGC GAg TAG TCC GCA CTG CGG GAT cTC AGC GCG CGA CCa CCG GAC TCG GTG ACC AGG CGC TGG GTC GGC TCT GCC TCG ACG GTT TCG CCT CCG CTG CCG GAC

121/41                       151/51                       181/61                       211/71
ACG CTG CTG CCC GCC GCG GCG GTG CTG ACC GAG GTC GCG GTA TGC GCC GGG CGC GGT GGC AGG TTG GCA TTG GCG TTC TGC AGC GGG GAG CAA TCC CAG CCG CCG GTG GCC GAT ACC TTG

241/81                       271/91                       301/101                      331/111
CAG TCG AAC TGA TCG GCG GCC TGT ACA GTC AAT GCT GCG ACC GGC TGC AGA GCC AGC AGG CTG CCG GTG ACC AGC AGG GGA AAC TTT CTT CGA AAC ACG AGG GAT TTC ACT GCC ATC TTG

361/121                      391/131                      421/141                      451/151
TTA ATC CGG GCT TCC TGC GCG CCA TCG GCC CGG TGG GCC GCA CGC CTC TCG ATG GGC TGA AAA AGA TGC TGG ATA ATA AAG CAT GAC CTG CGC AAC GGC TAG GGC CGT GGA GAA CCC CGT

481/161                      511/171                      541/181                      571/191
AAA TGT CTG ATG ATG CCC GTT TCC AGC AGC TGA ATc GCT GGT TGG ACT CTT GTT GCC CCG AGT TGT TCG TTG CCG AAG GTT GGG GGG AAG TGC CCC CCG CCG AAC TGA TCC CGG CCA GTA
                                                          M   S   D   D   A   R   F   Q   Q   L   N   R   W   L   D   S   C   L   P   E   L   F   V   A   E   G   W   G   E   V   P   P   A   E   L   I   P   A   S   S

601/201                      631/211                      661/221                      691/231
GCG ACG CCA GCT TCC GTC GTT ATT TCC GCT GGC AGG GAG GGG ACC GCA GCC TGG TGG TGA TGG ACG CGC CGC GCC CCC AGG AAG ACT GCC GAC CGT TCG TCA AGG TCG CCG GAC TGC TCG
D   A   S   F   R   R   Y   F   R   W   Q   G   G   D   R   S   L   V   V   M   D   A   P   P   P   Q   E   D   C   R   P   F   V   K   V   A   G   L   L   A

721/241                      751/251                      781/261                      811/271
CCG GAG CCG GCG TGC ATG TGC CGA GGA TTC TCG CCC AGG AtC TGG AGA ACG GTT TCC TGC TGC TCA GTG ACC TGG GCC GGC AGA CCT ACC TCG ACG TGC TTC ATC CCG GaA ATG CCG ACG
G   A   G   V   H   V   P   R   I   L   A   Q   D   L   E   N   G   F   L   L   L   S   D   L   G   R   Q   T   Y   L   D   V   L   H   P   G   N   A   D   E

841/281                      871/291                      901/301                      931/311
AGC TGT TCG AAC CGG CCC TGG ATG CGC TGA TCG CCT TCC AGA AGG TCG ATG TCG CCG GTG TCC TGC CTG CCT ACG ACG AAG CGG TGC TGC GCC GCG AGC TGC AGC TGT TCC CCG ACT GGT
L   F   E   P   A   L   D   A   L   I   A   F   Q   K   V   D   V   A   G   V   L   P   A   Y   D   E   A   V   L   R   R   E   L   Q   L   F   P   D   W   Y

961/321                      991/331                      1021/341                     1051/351
ACC TGG CCC GCC ACC TCG GCG TGG AGC TGG AGG GCG AGA CGC TGG CCC GCT GGc AgC GGA TCT GCG ACC TGC TGG TAC GCA GCG CGC TGG AGC AAC CGC GGG TGT TCG TCC ATC GCG ACT
L   A   R   H   L   G   V   E   L   E   G   E   T   L   A   R   W   Q   R   I   C   D   L   L   V   R   S   A   L   E   Q   P   R   V   F   V   H   R   D   Y

1081/361                     1111/371                     1141/381                     1171/391
ATA TGC CGC GCA AcC TGA TGC TCA GCG AGC CCA ACC CGG GCG TCC TCG ACT TCC AGG ACG CCC TGC ACG GCC CGG TCA CCT ACG ATG TCA CCT GCC TGT ACA AGG AtG CCT TCG TCA GTT
M   P   R   N   L   M   L   S   E   P   N   P   G   V   L   D   F   Q   D   A   L   H   G   P   V   T   Y   D   V   T   C   L   Y   K   D   A   F   V   S   W

1201/401                     1231/411                     1261/421                     1291/431
GGC GGA GCC GCG GCG TGC ATG CCG CGC TGA gtC GTT ACT GGA AGA AGG CGA CCT GGG CCG GCA TCC CGC TGC CGC AAC GCT CGA AgG ACT TCC TCC GcG CCA GCG ACC TGA TGG GCG TGC
P   E   P   R   V   H   A   A   L   S   R   Y   W   K   K   A   T   W   A   G   I   P   L   P   P   S   F   E   D   F   L   R   A   S   D   L   M   G   V   Q

1321/441                     1351/451                     1381/461                     1411/471
AGC GCC ACC TGA AGG TGA TTG GCA TCT TCG CCC GTA TtT GTC ACC GCG ACG GCA AGC CGC GCT ACC TGG GTG ACG TGC CaC GCT TCT TCC GTT ATC TGG AAA CCG CCG TGG CGC GCC GTC
R   H   L   K   V   I   G   I   F   A   R   I   C   H   R   D   G   K   P   R   Y   L   G   D   V   P   R   F   F   R   Y   L   E   T   A   V   A   R   R   P

1441/481                     1471/491                     1501/501                     1531/511
CCG AGC TGG CCG AAC TGG GCG AGC TGC TGG CCT CGC TGC CGC AGG GAG CCG AGG CAT GAA GGC GAT GAT CCT CGC CGC CGG cCG TGG CGA GCG CAT GCG GCC GAC CAC CCT GCA CAC GCC
M   K   A   M   I   L   A   A   G   R   G   E   R   M   R   P   T   T   L   H   T   P   E   L   A   E   L   G   E   L   L   A   S   L   P   Q   G   A   E   A

1561/521                     1591/531                     1621/541                     1651/551
CAA GCC GCT GAT CGA GGC CGC CGG CGT GCC ATT GAT CGA GCG TCA GTT GCT GGC GCT GCG CCA GGC CGG AGT CGA CGA CTG GGT GAT CAA CCA TGC CTG GCT TGG CGA GCA GAT CGA GGC
K   P   L   I   E   A   A   G   V   P   L   I   E   R   Q   L   L   A   L   R   Q   A   G   V   D   D   W   V   I   N   H   A   W   L   G   E   Q   I   E   A
```

Fig. 24K

```
1681/561                      1711/571                      1741/581                      1771/591
CTA TCT CGG CGA CGG cTC GCG CCT GGG CGG GCG GAT CGC CTA TTC aCC cGA GGG aGA ACC GCT GGA AAC CGG cGG tGG AAT CTT CCG CGC CCT GCC GTT GCT CGG CGA GCA GCC GTT CCT
 Y   L   G   D   G   S   R   L   G   G   R   I   A   Y   S   P   E   G   E   P   L   E   T   G   G   I   F   R   A   L   P   L   L   G   E   Q   P   F   L

1801/601                      1831/611                      1861/621                      1891/631
GTT GCT CAA CGG CGA TGT CTG GAG CGA CTT CGA CTA CTC TCG GCT GCA TCT TGC CGA CGG CGA CCT GGC GCA TCT GGT GCT GGT CGA CAA CCC GGC GCA CCA TCC CGC CGG CGA TTT CCA
 L   L   N   G   D   V   W   S   D   F   D   Y   S   R   L   H   L   A   D   G   D   L   A   H   L   V   L   V   D   N   P   A   H   H   P   A   G   D   F   H

1921/641                      1951/651                      1981/661                      2011/671
CCT GGA TGC CGG CGG ACG GGT GGG CGA GAC CCG CGA AGC GGG CGG CAA CCT gAC CTA CAG CGG GAT CGC CGT ACT GCA TCC CGC GCT GTT CGA GGG CTG CCA GCC GGG CGC CTT CAA GCT
 L   D   A   G   G   R   V   G   E   T   R   E   A   G   G   N   L   T   Y   S   G   I   A   V   L   H   P   A   L   F   E   G   C   Q   P   G   A   F   K   L

2041/681                      2071/691                      2101/701                      2131/711
GGC GCC GCT ATT GCG CAA GGC CAT CGC CGC GGG GCG GGT CAG CGG CGA ACA CtA TCG TGG GCA GTG GGT CGA CGT CGG TAC CCA CGA GCG CCT GGC GGA AGT CGA GCG ATT GCT GGC GGA
 A   P   L   L   R   K   A   I   A   A   G   R   V   S   G   E   H   Y   R   G   Q   W   V   D   V   G   T   H   E   R   L   A   E   V   E   R   L   L   A   E

2161/721                      2191/731                      2221/741                      2251/751
GCA CGC CTG AGA TGC TCT GGC CCG CTA CGC TGA TCG GAG CCG GAG CCG GCT GGG CCC TGG CCA GCA TCC CCG GCG CCC TGC TCG GCG GCC TGC TGG GGC AAC TGC TGG ACC GCA GGT GCC
 H   A   *   M   L   W   P   A   T   L   I   G   A   G   A   G   W   A   L   A   S   I   P   G   A   L   L   G   G   L   L   G   Q   L   L   D   R   R   L   R

2281/761                      2311/771                      2341/781                      2371/791
GCC TGG AGT CCT GGC GCG GCC TGC TGG CGC GCT TGC GCG GGC GGG CGG TGA ACG ATG AGG ACG ACC TGC TGT TcC AGT TGC TCG GCT ATC TGG CCA AGA GCG GCG GGC GGG TGG AGG AGA
 L   E   S   W   R   G   L   L   A   R   L   R   G   R   A   V   N   D   E   D   D   L   L   F   Q   L   L   G   Y   L   A   K   S   G   G   R   V   E   E   M

2401/801                      2431/811                      2461/821                      2491/831
TGC ATA TCC GCC AGG CGC GCG AGG AGA TGG CGT TGC GCA AGC TCG ATA GGC GAG CCC AGC GGC GTG CCA TCG CGT CCT TCG GCA AGG GCA AGG CCG GCA TCG CCC ATC TGC AGG CGG AGG
 H   I   R   Q   A   R   E   E   M   A   L   R   K   L   D   R   R   A   Q   R   R   A   I   A   S   F   G   K   G   K   A   G   I   A   H   L   Q   A   E   V

2521/841                      2551/851                      2581/861                      2611/871
TCG CGC GTC TGA AGG GCG AAC GTC GGA GGC AGT ATT GCC TCG CCT GCT GGC GGA TGG CCT GGG CTG GCG GCG TGC TCA GCC AGT CGG CGC GAC AAC TGG TGT TGC AAT GGG GGC GCT GGC
 A   R   L   K   G   E   R   A   E   A   V   L   L   A   C   W   R   M   A   W   A   G   G   V   L   S   Q   S   A   R   Q   L   V   L   Q   W   G   R   W   L

2641/881                      2671/891                      2701/901                      2731/911
TGG GTT GGT CGG CGG AGC GAA CGG AAC GCT TGT CGG CGC GGG TCA TGC CGA AGC GGA CGC GCG CTG TCG CCC GGG ATA GCT ACC GTG AGG CCC TGC TGC TGC TCG GCG TGG AGG CCG GAA
 G   W   S   A   E   R   T   E   R   L   S   A   R   V   M   P   K   R   T   R   A   V   A   R   D   S   Y   R   E   A   L   L   L   L   G   V   E   A   G   S

2761/921                      2791/931                      2821/941                      2851/951
GCG AGC CGG CGC TGA TCA AAC GCG CCT ATC GCA AGC TGA TCA GCC AGC ATC ATC CGG ACA AGC TGG CGG GAG CCG GCG CCA GCG TCG AGC GCG TGC GTG GCT ACG CCG AGA AAA CCC GTG
 E   P   A   L   I   K   R   A   Y   R   K   L   I   S   Q   H   H   P   D   K   L   A   G   A   G   A   S   V   E   R   V   R   A   A   T   E   K   T   R   E

2881/961                      2911/971                      2941/981                      2971/991
AAT TGC AGG CGG CCT ACG CCC TGG TCC GAG AGC GTG AGG GGT TCC GCT GAT CAC TCC GCA GGT TTC TGC GCA TCG GCC TGC AGG TGA AGA CTG AGC CAG CCG CGG ATT CGT CGG TAC AGT
 N   C   R   R   P   T   P   W   S   E   S   V   R   G   S   A   D   H   S   A   G   F   C   A   S   P   A   R   *

3001/1001                     3031/1011                     3061/1021                     3091/1031
TGC TCC TGC TCC GCC TTG GGG TCG GCC GGT AGa GCC TGC ATC GCG ATT TGT ACG TAG GCc GGG TGT TTC TGC CGC TTG CCG GCC TGC ATG CGC AGC CTG GCC GCC TCG GGG TCG GCG CG
```

Fig. 24L

PhnA and PhnB SEQ ID NO: 129

```
   1 CTGCAGCGTC TGCCGACCCT GCTGCAACTG ATCCCGGGAC ACGGCGGCCT
  51 GCTGCGGGGG CGGCTGGCCG CGGATGGGGC CGAGTCGGCC TATACCGAGT
 101 GTCTGCGCCT GTGCCGACGG TTGCTCTGGC GCCAGTCCAT GGGCGAGTCC
 151 CTCGACGAAC TGAGCGAGGA GCTGCACCGC GCCTGGGGAG GGCAGAGCGT
 201 CGACTTCCTG CCCGGCGAAC TGCACCTGGG GAGCATGCGC CGGATGCTGG
 251 AGATTCTCTC CCGCCAGGCG CTGCCTCTGG ACTGAGGCGG AACATCCATT
 301 GCGGCGATCG CGCCCGACGG CTGCGGTCGC AATTGGGGGA AATGGGGGTA
 351 TCGATGATGA ATATGCCGTT GCGCGCTAGC GTCGCGCAGG CCAGTCGCCC
 401 ATGGGCGCGG GGAGGTGGCT CGTGAGTGGG GTTGGCTATC GACTGGAAGA
 451 AAGTCTGGAG TACCGCACGC TGGTGCCGGA GGCGCTGTCG ATCTGGCGCA
 501 TGGCTGGCGC CAACCGGATG CTGTTCGACT GCTTCGACGT GGACAGCAAG
 551 GCTGCGCGGC GTAGCGTGGC GATCCTTTCC AGCTGCCTGC GCATCGAGTG
 601 CTGGGGGCGC GATGTGGTGC TGCGGGCGTT GAACTCCAAC GGACGCGCCT
 651 TGCTGGCGCC GTTGAGCGAG GCCTGTCCGG CCCAGGTCAC CTGCTTGCGT
 701 GACGGCGACA CCCTGCACTG GCGCTTCCCC CCGGAAGAGC CGCATGCGGA
 751 CGAGTGGCGA CGCCTGCATG GCCTGTCCAG CCTGGAGGCG CTGCGCCGCG
 801 TGCTCGGAAC GCTGGGCGAC GCGGAGGGGC CTGCGCTGCT GGGCGGCCTG
 851 TTCAGTTTCG ACCTGGCCGA GCAGTTCGAA CCCTTGCCGG CGCCGGCCGA
 901 ACCTGCGCGG CATTGCCCGG ACTACCTGTT CCTGGTGCCG GAGTTGCTGC
 951 TGGATATCGA TCACCTGGCG CGCCGGACTT CGCTGCAAGC GTTCGTCCAC
1001 GATCCGGCCG GGCACGACCG GTTGGCCGCC AGCCTGCGCC AATGTGCCGA
1051 CGAATTCCAT GGCGCCGTGG AGGAGGCTTC CGAGTCGCCG GTGGCAGGCG
1101 TACGGGCCGG CAACTACCAG GTCGACCTGG ACGATGCGAG CTTTGCCCGC
1151 CAGGTAGAAC GCCTGCAGGC CCACGTGAGG GCCGGCGACG TGTTCCAGAT
1201 CGTACCTTCG CGCAGCTTCA GCATGCCGTG CGCGGACCCC TGGCGGGCCT
1251 ATCGCCAGTT GTGCCTGCGC AACCCCAGCC CGTACCGCTT CTTCCTCGAT
1301 GCGGGGGACT TCTGCCTGTT CGGCGCTTCG CCGGAGTCGG CATTGAAGTA
1351 CGACGCGGAG AGTCGCGAGG TGGAACTCTA TCCCATTGCC GGCACCCGCC
1401 CGCGCGGATG CGATGCCCGG GGCGCCATCG ATGCGGAACT GGACAATCGC
1451 CTGGAAGCGG AGTTGCGCCT GGATGCCAAG GAGATCGCCG AGCACATGAT
1501 GCTGGTCGAC CTGGCGCGCA ACGATCTGGC GCGCGTCTGC CGCAGCGGTA
1551 CCCGGCAGGT GCGCGACATG CTCAAGGTCG ATCGCTACAG CCACGTGATG
1601 CACCTGGTCT CGCGCGTGGC TGGCGAACTG CACGGCGAAC TGGATGCGCT
1651 GCATGCCTAC CGTGCCTGCC TGAACATGGG CACCCTGGTC GGCGCGCCGA
1701 AGGTCCGTGC CATGCAGTTG CTGCGGCAGT ACGAGGATGG CTATCGCGGC
1751 AGCTACGGTG GTGCGATCGG CATTCTCGAC AGCGCCGGCA ACCTCGATAC
1801 CAGCATTGTC ATCCGCTCCG CCGAGGTCCG CGAAGGTATC GCGCGGGTTC
1851 GGGCAGGCGC CGGCGTGGTG CTGGATTCGG ATCCACGGCT GGAGGCCGAG
1901 GAAACCCGCA CAAGGCGCT GGCGGTGCTG ACCGCCGTGG CCGCTGCCGA
1951 ACGCGAAAGG GGAGAGCGCG ATGCGCATCA CGCTGTTGGA TAACTTCGAT
2001 TCCTTCACCT ACAACCTGGT CGAGCAGTTC TGCCTGCTCG GCGCGGAGGT
2051 CCGGGTGATG CGCAACGATA CGCCGTTGCC GACGATCCAG GCGGCATTGC
2101 TGGCCGACGG TTGCGAACTG CTGGTGCTGT CGCCGGGGCC CGGTCGGCCG
```

Fig. 25A

```
2151 GAAGACGCCG GCTGTATGCT GGAATTGCTC GCCTGGGCCC GCGGGCGCTT
2201 GCCGGTGCTC GGCGTCTGCC TCGGCCACCA GGCGCTGGCG CTGGCCGCCG
2251 GTGGCGCGGT GGGCGAGGCG AGGAAGCCGC TGCATGGCAA GAGCACGTCC
2301 CTGCGTTTCG ATCAGCGTCA CCCGCTGTTC GACGGCATCG CTGACCTGCG
2351 CGTCGCGCGC TACCACTCGC TGGTGGTCAG TCGCCTGCCG GAAGGTTTCG
2401 ACTGCCTGGC CGATGCCGAT GGCGAGATCA TGGCGATGGC CGATCCGCGC
2451 AATCGACAGC TGGGCTTGCA ATTCCATCCC GAGTCGATTC TCACCACCCA
2501 CGGCCAGCGT CTGCTGGAGA ACGCTCTACT CTGGTGCGGC GCGTTGGCGG
2551 TCGCGGAGCG CCTTCGGGCC TGAGCGGCGC TGCGCAGTTT CGACCGAGGC
2601 TCGGTTGCCA GGCCGGCGCA TCGTCGAAAC GCTGGCGGCC CAGTTCGCGC
2651 AGGCGCTGGC GGGCGCTTTC GAGAAAGCGA CGGAAGCTGC GCTCGGATTC
2701 CAGCGCGGTG TTGTAGTAGC AATACACCTT GGTGTCGATG CCGCCCGGTT
2751 CGTACAGTTC GCTGAGGACT GCCAGGGTAC CGTTGCGCAG GCGTTCCTcG
2801 ACGAAATAAT GCGGCGaGAT GCCCCATCCG ACGCCGGCTT CCACCAGACG
2851 CAGCATGTCG TCGAAGTTTT CCACGAAGAG CACCTTGTCG CTGACCGGCC
2901 GCAGCAGGTT CGAATGCTGC CCGGAGCGGC TgCCGAGGCT GATCTGCCGG
2951 TAATTGGCCA GGCTCGCGAT GCTGTGCAGG GAGGCATTGC ACAACGGGTG
3001 CTGCGGATGG GCGACGACGA ACGCCTTGGT GTAGCCGAGC ACGCACTGGT
3051 TGAAGCGGGA GATCT
```

Fig. 25B

PhnA protein SEQ ID NO:130

```
  1 MGARRWLVSG VGYRLEESLE YRTLVPEALS IWRMAGANRM LFDCFDVDSK
 51 AARRSVAILS SCLRIECWGR DVVLRALNSN GRALLAPLSE DCPAQVTCLR
101 DGDTLHWRFP QEESHADEWR RLHGLSSLEA LRRVLGTLGD AEGPVLLGGL
151 FSFDLAEQFE PLPAPAEPAR HCPDYLFLVP ELLLDIDHLA RRTSLQAFVH
201 DPAGHDRLAA SLRQCADEFH GAVEEASESP VAGVRAGNYQ VDLDDASFAR
251 QVERLQAHVR AGDVFQIVPS RSFSMPCADP WRAYRQLCLR NPSPYRFFLD
301 AGDFCLFGAS PESALKYDAE SREVELYPIA GTRPRGRDAR GAIDAELDNR
351 LEAELRLDAK EIAEHMMLVD LARNDLARVC RSGTRQVRDM LKVDRYSHVM
401 HLVSRVAGEL HGELDALHAY RACLNMGTLV GAPKVRAMQL LRQYEDGYRG
451 SYGGAIGILD SAGNLDTSIV IRSAEVREGI ARVRAGAGVV LDSDPRLEAE
501 ETRNKALAVL TAVAAAERER GERDAHHAVG
```

Fig. 26

PA14 degP SEQ ID NO:131

```
   1 CGTCCGATTC GGCCTGAGTC TTTCTCTTCC CTCGAACATC ACGGGAGCTG TAGTCGATGC
  61 ATACCCTAAA ACGCTGTATG GCTGCGATGG TGGCCTTGCT GGCCTTGAGC CTGGCGATGA
 121 CGGCCCGGGC AGAACTGCCG GACTTCACGC CTTTGGTCGA ACAGGCGTCG CCGGCGGTGG
 181 TGAATATCAG TACGCGGCAG AAGCTGCCGG ATCGCGCCAT GGCGCGCGGG CAGCTGTCGA
 241 TCCCCGACCT CGAAGGGCTG CCGCCGATGT CCGCGACTT CCTCGAGCGC ACGATCCCGC
 301 AGGTTCCGCG CAATCCGCGC GGCCAGCAGC GCGAGGCGCA ATCGCTGGGC TCCGGCTTCA
 361 TCATCTCCAA CGACGGCTAC ATCCTCACCA CAATCACGT CGTGGCCGAT GCCGACGAGA
 421 TCCTGGTGCG CCTGTCCGAC CGTAGCGAGC ACAAGGCCAA GCTGGTCGGC GCGGACCCGC
 481 GCAGCGACGT GGCGGTGCTG AAGATCGAGG CGAAGAACCT GCCGACCCTG AAACTGGGCG
 541 ATTCGAACAA GCTGAAAGTG GGCGAATGGG TCCTGGCCAT CGGTTCGCCG TTCGGCTTCG
 601 ATCACTCGGT CACCGCCGGT ATCGTCAGTG CCAAGGGGCG TAGCCTGCCG AACGAGAGCT
 661 ACGTACCCTT CATCCAGACC GACGTGGCGA TCAACCCGGG CAACTCCGGC GGTCCGCTGC
 721 TGAACCTGGA GGGCGAAGTG GTCGGCATCA ACTCGCAGAT CTTCACCCGT TCCGGCGGCT
 781 TCATGGGCCT GTCCTTCGCC ATCCCGATCG ATGTCGCGCT GAACGTCGCC GACCAGTTGA
 841 AGAAAGCCGG CAAGGTCAGC CGCGGCTGGC TGGGTGTGGT GATCCAGGAA GTGAACAAGG
 901 ATCTCGCCGA GTCCTTCGGC CTCGACAAGC CGTCCGGCGC GCTGGTGGCG CAGCTGGTGG
 961 AAGACGGTCC GGCGGCCAAG GGCGGCCTGC AGGTGGGCGA TGTGATCCTC AGCCTGAACG
1021 GCCAGTCGAT CAACGAGTCC GCCGACCTGC CGCACCTGGT GGGCAACATG AAGCCGGGCG
1081 ACAAGATCAA CCTGGACGTG ATTCGCAACG GCCAGCGCAA GTCCTTGAGC ATGGCGGTAG
1141 GCAACCTTCC GGACGACGAC GAGGAAATCG CCTCGATGGG CGCTCCGGGC GCCGAGCGCA
1201 GCAGCAACCG CCTGGGCGTG ACCGTCGCCG ACCTGACCGC CGAGCAGCGC AAGAGCCTGG
1261 ATATCCAGGG CGGCGTGGTG ATCAAGGAAG TCCAGGACGG TCCGGCCGCG GTCATCGGCC
1321 TGCGTCCGGG CGATGTCATC ACCCACCTGG ACAACAAGGC GGTGACCTCG ACCAAGATCT
1381 TCGCCGACGT GGCCAAGGCC CTGCCGAAGA ACCGTTCGGT TTCGATGCGG GTACTG
```

Fig. 27

PA14 degP protein SEQ ID NO: 132

```
  1 MHTLKRCMAA MVALLALSLA MTARAELPDF TPLVEQASPA VVNISTRQKL
 51 PDRAMARGQL SIPDLEGLPP MFRDFLERTI PQVPRNPRGQ QREAQSLGSG
101 FIISNDGYIL TNNHVVADAD EILVRLSDRS EHKAKLVGAD PRSDVAVLKI
151 EAKNLPTLKL GDSNKLKVGE WVLAIGSPFG FDHSVTAGIV SAKGRSLPNE
201 SYVPFIQTDV AINPGNSGGP LLNLEGEVVG INSQIFTRSG GFMGLSFAIP
251 IDVALNVADQ LKKAGKVSRG WLGVVIQEVN KDLAESFGLD KPSGALVAQL
301 VEDGPAAKGG LQVGDVILSL NGQSINESAD LPHLVGNMKP GDKINLDVIR
351 NGQRKSLSMA VGNLPDDDEE IASMGAPGAE RSSNRLGVTV ADLTAEQRKS
401 LDIQGGVVIK EVQDGPAAVI GLRPGDVITH LDNKAVTSTK IFADVAKALP
451 KNRSVSMRVL
```

Fig. 28

PA 8830 algD SEQ ID NO:133

```
   1 GCGCGACAAA CAATCGAGGT GAATGCGATG CGAATCAGCA TCTTTGGTTT
  51 GGGCTATGTC GGTGCAGTAT GTGCTGGCTG CCTGTCGGCA CGCGGTCATG
 101 AAGTCATTGG TGTGGATGTC TCCAGCACCA AGATCGACCT GATCAACCAG
 151 GGCAAGTCGC CCATCGTCGA ACCGGGCCTG GAAGCGTTGT TGCAGCAAGG
 201 CCGGCAGACC GGACGGCTGT CGGGCACCAC CGACTTCAAG AAGGCTGTGC
 251 TGGACTCCGA CGTATCGTTC ATCTGCGTCG GCACGCCGAG CAAGAAGAAC
 301 GGCGACCTGG ACCTGGGCTA CATCGAGACC GTCTGCCGCG AGATCGGCTT
 351 CGCCATCCGC GAGAAGTCCG AACGCCACAC CGTGGTGGTG CGCAGCACCG
 401 TACTGCCGGG CACCGTCAAC AACGTGGTGA TCCCGCTGAT CGAGGACTGC
 451 TCGGGCAAGA AGGCCGGGGT CGACTTCGGC GTCGGCACCA ACCCCGAATT
 501 CCTCCGCGAG AGCACCGCGA TCAAGGACTA CGACTTCCCG CCGATGACCG
 551 TGATCGGCGA ACTGGACAAG CAGACCGGCG ACCTTCTCGA GGAAATCTAC
 601 CGCGAGCTGG ACGCGCCGAT CATCCGCAAG ACCGTCGAGG TCGCCGAGAT
 651 GATCAAGTAC ACCTGCAACG TCTGGCACGC CGCCAAGGTC ACCTTCGCCA
 701 ACGAGATCGG CAACATCGCC AAGGCGGTCG GCGTCGACGG CCGCGAGGTG
 751 ATGGACGTGA TCTGCCAGGA CCACAAGCTC AACCTGTCGC GCTACTACAT
 801 GCGTCCCGGC TTCGCCTTCG GCGGCTCCTG CCTGCCCAAG GATGTACGCG
 851 CCCTCACCTA TCGCGCCAGC CAGCTGGACG TCGAGCACCC GATGCTCGGT
 901 TCGTTGATGC GCAGCAACTC CAACCAGGTG CAGAAGGCCT TCGATCTCAT
 951 CACCAGCCAC GACACCCGCA AGGTCGGCCT GCTCGGCCTG TCGTTCAAGG
1001 CCGGCACCGA CGATTTGCGC GAAAGCCCGC TGGTGGAGCT GGCCGAGATG
1051 CTCATCGGCA AGGGCTACGA GTTCCGCATC TTCGACCGCA ACGTCGAATA
1101 CGCGCGTGTC CACGGGGCCA ACAAGGAATA CATCGAGTCG AAGATCCCGC
1151 ACGTCTCCTC GCTGCTGGTC TCCGACCTCG ACGAAGTGGT GGCGAGTTCC
1201 GATGTGCTGG TGCTGGGCAA TGGCGACGAG CTGTTCGTCG ACCTGGTGAA
1251 CAAGACCCCG AGCGGCAAGA AGCTGGTCGA CCTGGTGGGC TTCATGCCGC
1301 ACACCACCAC TGCCCAGGCC GAGGGCATCT GCTGGTAGCG G
```

Fig. 29

PA 8830 algD protein SEQ ID NO: 134

```
  1 MRISIFGLGY VGAVCAGCLS ARGHEVIGVD VSSTKIDLIN QGKSPIVEPG
 51 LEALLQQGRQ TGRLSGTTDF KKAVLDSDVS FICVGTPSKK NGDLDLGYIE
101 TVCREIGFAI REKSERHTVV VRSTVLPGTV NNVVIPLIED CSGKKAGVDF
151 GVGTNPEFLR ESTAIKDYDF PPMTVIGELD KQTGDLLEEI YRELDAPIIR
201 KTVEVAEMIK YTCNVWHAAK VTFANEIGNI AKAVGVDGRE VMDVICQDHK
251 LNLSRYYMRP GFAFGGSCLP KDVRALTYRA SQLDVEHPML GSLMRSNSNQ
301 VQKAFDLITS HDTRKVGLLG LSFKAGTDDL RESPLVELAE MLIGKGYEFR
351 IFDRNVEYAR VHGANKEYIE SKIPHVSSLL VSDLDEVVAS SDVLVLGNGD
401 ELFVDLVNKT PSGKKLVDLV GFMPHTTTAQ AEGICW
```

Fig. 30

>Contig1126 of Mutant 25A12 SEQ ID NO: 135

..AACACCGGACGCGCCCCGATCATGTGCGCTGAGCGCTACGCTACCGTCAA
CGAAAAAGGCCACCTCGGGGTGGCCTTTTCGCGTTCTCGCACCGATCGCG
CGGAATATCGGCGGTTAACGCCTCTCCCCCGTGCGCACCTGCGGCTGAGC
CTCAGAACGAAGTCCGGCGGTAGGCACGGTAGCGCGGGAACCAGAAGTTC
GCCTCGATGGCGTCGTTCAGTACCTCGTCGCTGGTATGCAGGGCCTTGCC
CTCGGCCTGGGCCTGCTTGGCCACGGCGACGGCGATGCGCTTGCTGACCT
CGCGGATGTCGCCCAGCGCCGGCAACACGGCGCCCTCGCCCTGGGTAACG
ATCGGCGAGCAGTTGGCCAGGGCGTTGGCCGCGGCCATCAGCATGCCTTC
GGTGACCCGATTGGCCCGCGCGGCGATCACCCCCAGGCCGATGCCGGGGA
AGATATAGGCGTTGTTGCACTGGGCGATGGGAATCCGCTTGTCGCCCACC
TGCACCGGTTGGAACGGGCTACCGGTGGCGACCAGCGCCTGGCCGTCGGT
CCAGTTGAGGATTTCCTGCGGAGTCGCCTCGACCCGCGAGGTCGGGTTGG
ACAGCGGCATCACCAGCGGCTGCTTGCAATGGCTGTGCAGCTCACGGATG
ACCTCTTCGGAAAACAGCCCGCGCTGCCCGGAGACGCCGATCAGCACCGT
CGGCCGGGCATTGCGGATCACTTCCAGCAACGCCAGGTCGTCGCCCTGCT
GGCCGCCCCAGGCACCGAGATCGGCGCGCTTCTGCGCCAGGCGGTGCTGG
AAGTCGACCAGGTTGCTCATGTCGTCGGTGAGCAGGCCCCAGCGGTCGAC
CATGAAGATGCGCCGACGCGCCTGGGCCTCGTCCAGGCCCTCCAGTTGCA
TGGCGGCGATGATCTGTTCGGCGATGCCGCAACCGGCGGAGGGGCGCCGA
CGAAGGTCACGGTCTGCTCGCTGAGCTTCTCGCCCTTGGCCTTGCAAGCC
GCCAGCAGGGTGCCCACGGCCACCGCGGCGGTGCCCTGGATGTCGTCGTT
GAAGCAGCACAGCTCGTCCTTGTAGCGCTCCAGCAACGGCATGGCATTGG
TCTGGGCGAAGTCCTCGAATTGCAGCAGGACGTTGGGCCAGCGGCGCTTG
ATCGCCTGGATGAACAGGTCGACGAACTCCTCGTACTGCGCCCCGCTCAC
CCGCTCGTGGCGCCACCCAATGTACATCGGGTCGTTGAGCAGGTCCGGGT
TGTTGGTGCCGACGTCCAGCACCACCGGCAGGGTGTAGGCCGGGCTGATA
CCGCCGCAGGTGTAACAGGGGACAGCTTGCCGATCGGGATGCCCATCCGG
CCGATGCCCTGGTTGCCGAGGGCGAGGATCGGCTGGCTGTCGGTACAAAA
CAATCTAAGGTGTCTTTGGTGGCTTGAAGGAGTTTCAATCGTTCGGGCCG
GGAAGAATAAAGGCCCGGTGGGTCGAAACTTTGAATCTGGAAGGTTGCAA
ACTGGGGGAAAAATGGAAATTTTTAAGAGCCTAAGAGCGGAAAAAAGTT
CTTTTTCTAAAAAGAAAAAAATGGGGAAAAAGTTGAAAAGTATATGATAA
GAGCAGGTGTCAAAATGAATGTTTTGAAAGCCCAGTGAAATAAACTCTGG
AAAAGGCAGTTATAAGGGCTATAAAAGGGATGAAAAAAGAAGTGTGTGAA
ATAACGAAAGGCAATAGGGAAAA

Fig. 31

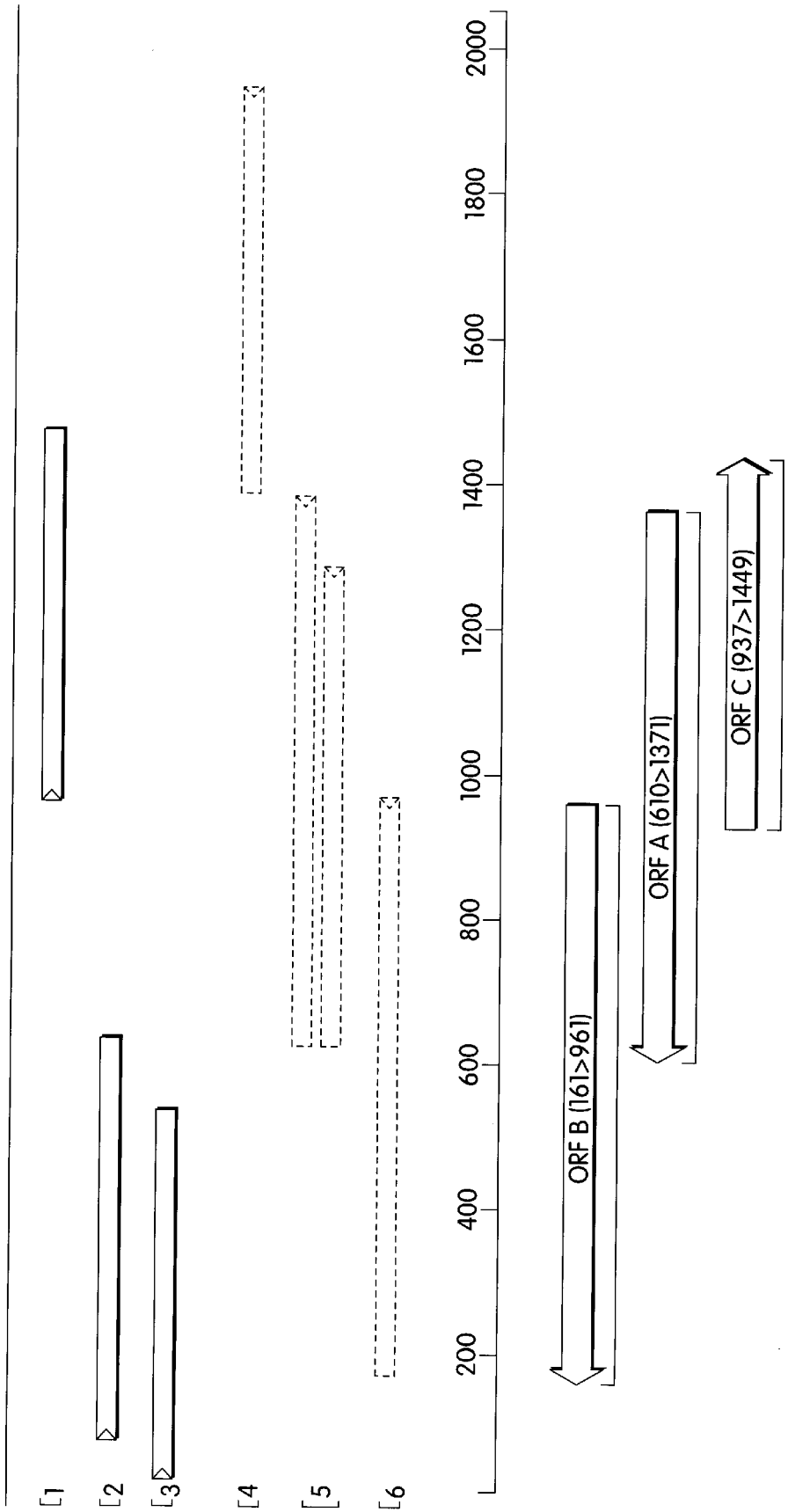

Sequence: 33C7 contig From: 1 To: 2048

```
          10         20         30         40         50         60
AGCTTATGCA TGCGGCCGCA TCTAGAGGGC CCGGATCCGG TGACCATCGG TCACCGGCAT  60
GCCGGTGGTT TCGGTATCCA GTACGACGCT ACGCATCTAT AGAGCCTTTC TCTGTTTCGC 120
TGCAGCCGTG GCTGCTGAAC GCTTGTTTCG GTGTGGCCGC TCAGCGCGGC AATTCGGCGA 180
CGCCACGGTT GGCCAACTGG TCGGCCCGCT CGTTGCCGGG GTCGCCGGTA TGCCCGCGGA 240
CCCACTGCCA CTCCACCTGG TGCCGGGCGA CCTGTTCATC CAGGGCCTGC CAGAGGTCGG 300
         310        320        330        340        350        360
CATTCTTGAC AGGCTGCTTG CTGGCGGTCT TCCAGCCGCG CTTCTTCCAG TTCGGCAACC 360
ATTCGGTGAT GCCGCGCATC ACGTATTCCG AGTCGGTGAT CAGACGGATC GGACAGGAAC 420
GCTTGAGTGC CGCCAGCGCC TGGATCGCCG CCATCAGCTC CATGCGGTTG TTGGTGGTGT 480
CCGGCTCGCC GCCCCAAAGC TCTCGCTCGG CGCCCTTGTA GAGGAGCAAC GCCCCCAGC 540
CGCCGCGCCC AGGGTTGCCC TTGCAGGCGC CGTCGGTATA GATCACTACC TGTTCTTTAT 600
         610        620        630        640        650        660
CTGTCATGCC TAAATTTCGG AATCTCGCCG GCTGACTTTC GCCACCGGCA TGGGCACCAG 660
CTGACCGCGC GGTTCGCGCT TGCTCTGGCG CAACGGGCGC AACCCCACGA CCAGCTTGCG 720
TGCCACCAAT AGATAGAAGC CGGCGCCCGA AGACTGCCAG GCGTCGCCCC AGCGCTCCAG 780
GCGAGCCAGG CGCGATTGCC AGGCTGCCGA CGCAAGCGGC GGACGATAGC ACCCGAAGCG 840
CCGTTTCTCC AGCGCGAAGC CCAGCAGGTT GAGCCAATCG CAGGCCCGCG ACGGAGGAAT 900
         910        920        930        940        950        960
GCAGCGGGCC TGGCGCAAGG CATCCCCGGC GAAATAATGA CGGATGCCCC ACAGGCTCCA 960
TGGGTTGATG CCGATCAGCA GCAGGTGGCC GCCCGGACGA ACGGTACGCG CGGCTTCGCG 1020
CAGGAGACGG TGAGGCGACA GGCAGAAATC CAGGCCGTGT TGCAGCAGGA CCACGTCCGC 1080
GGCATGTTCG CTGAGCGGCC AGGCGCCCTC TTCGCAGGCG ATGTCCACGC CCGGCAGCGG 1140
CGGCCCCAGG CGCACGCCGC GCTGAATCTG CCCGGTGCTC GGCGGCAGTT CGGCATGCGG 1200
        1210       1220       1230       1240       1250       1260
CCCGTAGTGC ACCAGGTAGC CACCGAAGTA ACGGGTCAGC TCGTCGCACA ACAGGCGTCG 1260
CTCCTCGGCC AGCATCAGGC TGCCCAGCGG GCCCTGGAAC CAGTCGCGCG CCCGGTTGAT 1320
CGATGCCAGC CACTCGGCAT CGGTCTGGGC GAAGGCTTGC GGTTCGTTCA TGCGTACCTC 1380
CAGCGTCTTC CCCTTCGCGG CGACGGACGC CGGCACGACG GGAAAATAAG CAATACTATG 1440
CGCCAATGAC TTCTGCTTAG CGACATCGAC CCATGATACA GATCGACGCC CTGCCCGCCT 1500
```

Fig. 32B

Sequence: 33C7 contig From: 1 To: 2048 (continued)

```
          1510       1520       1530       1540       1550       1560
TCAACGACAA CTACATCTGG CTGTTGCAAG ATGCGACAAG CCGTCGCTGC GCGGTGGTCG 1560
ACCCCGGCGA TGCCAAGCCG GTGGAAGCCT GGCTGGCCGC CCATCCCGAC TGGCGGTTGA 1620
GCGATATCCT GGTGACCCAC CACCATCACG ACCACGTCGG CGGCGTCGCG GCCCTGAAGG 1680
AACTGACCGG CGCGCGGGTT CTCGGCCCGG CCAACGAGAA GATCCCGGCC CGCGACCTGG 1740
CGCTGGAAGA CGGCGAACGG GTCGAGGTGC TCGGCCTGGT CTTCGAGATC TTCCACGTGC 1800
          1810       1820       1830       1840       1850       1860
CCGGCCATAC CCTCGGCCAT ATCGCCTACT ACCACCCGGC GGAGACGCCG CTGCTGTTCT 1860
GCGGCGACAC CCTGTTCGCC GCCGGCTGCG GCCGTCTCTT CGAAGGCACC CCGGCGCAGA 1920
TGCACCATTC CCTGGCGCGA CTGGCCGCGC TGCCGGCCAA CACCCGGGTC TACTGCACCC 1980
ACGAGTACAC GCTGAGCAAC CTGCGCTTCG CGCTGGCGGT GGAGCCCGAC AACGCGGCGC 2040
TGCGGGAA 2048
```

Fig. 32C

33C7 ORF A

```
ATGAACGAAC CGCAAGCCTT CGCCCAGACC GATGCCGAGT 40
GGCTGGCATC GATCAACCGG GCGCGCGACT GGTTCCAGGG 80
CCCGCTGGGC AGCCTGATGC TGGCCGAGGA GCGACGCCTG 120
TTGTGCGACG AGCTGACCCG TTACTTCGGT GGCTACCTGG 160
TGCACTACGG GCCGCATGCC GAACTGCCGC CGAGCACCGG 200

GCAGATTCAG CGCGGCGTGC GCCTGGGGCC GCCGCTGCCG 240
GGCGTGGACA TCGCCTGCGA AGAGGGCGCC TGGCCGCTCA 280
GCGAACATGC CGCGGACGTG GTCCTGCTGC AACACGGCCT 320
GGATTTCTGC CTGTCGCCTC ACCGTCTCCT GCGCGAAGCC 360
GCGCGTACCG TTCGTCCGGG CGGCCACCTG CTGCTGATCG 400

GCATCAACCC ATGGAGCCTG TGGGGCATCC GTCATTATTT 440
CGCCGGGGAT GCCTTGCGCC AGGCCCGCTG CATTCCTCCG 480
TCGCGGGCCT GCGATTGGCT CAACCTGCTG GGCTTCGCGC 520
TGGAGAAACG GCGCTTCGGG TGCTATCGTC CGCCGCTTGC 560
GTCGGCAGCC TGGCAATCGC GCCTGGCTCG CCTGGAGCGC 600

TGGGGCGACG CCTGGCAGTC TTCGGGCGCC GGCTTCTATC 640
TATTGGTGGC ACGCAAGCTG GTCGTGGGGT TGCGCCCGTT 680
GCGCCAGAGC AAGCGCGAAC CGCGCGGTCA GCTGGTGCCC 720
ATGCCGGTGG CGAAAGTCAG CCGGCGAGAT TCCGAAATTT 760
AG 762
```

Fig. 32D

Sequence: 33C7 ORF A From: 1 To: 254

```
          10         20         30         40
MNEPQAFAQT DAEWLASINR ARDWFQGPLG SLMLAEERRL  40
LCDELTRYFG GYLVHYGPHA ELPPSTGQIQ RGVRLGPPLP  80
GVDIACEEGA WPLSEHAADV VLLQHGLDFC LSPHRLLREA 120
ARTVRPGGHL LLIGINPWSL WGIRHYFAGD ALRQARCIPP 160
SRACDWLNLL GFALEKRRFG CYRPPLASAA WQSRLARLER 200

WGDAWQSSGA GFYLLVARKL VVGLRPLRQS KREPRGQLVP 240
MPVAKVSRRD SEI. 254
```

Fig. 32E

Sequence: 33C7 ORF B From: 1 To: 801

```
          10         20         30         40         50         60
ATGGAGCCTG TGGGGCATCC GTCATTATTT CGCCGGGGAT GCCTTGCGCC AGGCCCGCTG  60
CATTCCTCCG TCGCGGGCCT GCGATTGGCT CAACCTGCTG GGCTTCGCGC TGGAGAAACG 120
GCGCTTCGGG TGCTATCGTC CGCCGCTTGC GTCGGCAGCC TGGCAATCGC GCCTGGCTCG 180
CCTGGAGCGC TGGGGCGACG CCTGGCAGTC TTCGGGCGCC GGCTTCTATC TATTGGTGGC 240
ACGCAAGCTG GTCGTGGGGT TGCGCCCGTT GCGCCAGAGC AAGCGCGAAC CGCGCGGTCA 300
          310        320        330        340        350        360
GCTGGTGCCC ATGCCGGTGG CGAAAGTCAG CCGGCGAGAT TCCGAAATTT AGGCATGACA 360
GATAAAGAAC AGGTAGTGAT CTATACCGAC GGCGCCTGCA AGGGCAACCC TGGGCGCGGC 420
GGCTGGGGGG CGTTGCTCCT CTACAAGGGC GCCGAGCGAG AGCTTTGGGG CGGCGAGCCG 480
GACACCACCA ACAACCGCAT GGAGCTGATG GCGGCGATCC AGGCGCTGGC GGCACTCAAG 540
CGTTCCTGTC CGATCCGTCT GATCACCGAC TCGGAATACG TGATGCGCGG CATCACCGAA 600
          610        620        630        640        650        660
TGGTTGCCGA ACTGGAAGAA GCGCGGCTGG AAGACCGCCA GCAAGCAGCC TGTCAAGAAT 660
GCCGACCTCT GGCAGGCCCT GGATGAACAG GTCGCCCGGC ACCAGGTGGA GTGGCAGTGG 720
GTCCGCGGGC ATACCGGCGA CCCCGGCAAC GAGCGGGCCG ACCAGTTGGC CAACCGTGGC 780
GTCGCCGAAT TGCCGCGCTG A 801
```

Fig. 32F

Sequence: 33C7 ORF B PROTEIN From: 1 To: 267

```
          10         20         30         40         50
MEPVGHPSLF RRGCLAPGPL HSSVAGLRLA QPAGLRAGET ALRVLSSAAC  50
VGSLAIAPGS PGALGRRLAV FGRRLLSIGG TQAGRGVAPV APEQARTARS 100
AGAHAGGESQ PARFRNLGMT DKEQVVIYTD GACKGNPGRG GWGALLLYKG 150
AERELWGGEP DTTNNRMELM AAIQALAALK RSCPIRLITD SEYVMRGITE 200
WLPNWKKRGW KTASKQPVKN ADLWQALDEQ VARHQVEWQW VRGHTGDPGN 250
          260        270        280        290        300
ERADQLANRG VAELPR. 267
```

Fig. 32G

33C7 ORF C

```
          10         20         30         40         50         60
ATGACGGATG CCCCACAGGC TCCATGGGTT GATGCCGATC AGCAGCAGGT GGCCGCCCGG  60
ACGAACGGTA CGCGCGGCTT CGCGCAGGAG ACGGTGAGGC GACAGGCAGA AATCCAGGCC 120
GTGTTGCAGC AGGACCACGT CCGCGGCATG TTCGCTGAGC GGCCAGGCGC CCTCTTCGCA 180
GGCGATGTCC ACGCCCGGCA GCGGCGGCCC CAGGCGCACG CCGCGCTGAA TCTGCCCGGT 240
GCTCGGCGGC AGTTCGGCAT GCGGCCCGTA GTGCACCAGG TAGCCACCGA AGTAACGGGT 300
          310        320        330        340        350        360
CAGCTCGTCG CACAACAGGC GTCGCTCCTC GGCCAGCATC AGGCTGCCCA GCGGGCCCTG 360
GAACCAGTCG CGCGCCCGGT TGATCGATGC CAGCCACTCG GCATCGGTCT GGGCGAAGGC 420
TTGCGGTTCG TTCATGCGTA CCTCCAGCGT CTTCCCCTTC GCGGCGACGG ACGCCGGCAC 480
GACGGGAAAA TAAGCAATAC TATGCGCCAA TGA 513
```

Fig. 32H

Sequence: 33C7 ORF C PROTEIN From: 1 To: 171

```
          10         20         30         40         50
MTDAPQAPWV DADQQQVAAR TNGTRGFAQE TVRRQAEIQA VLQQDHVRGM  50
FAERPGALFA GDVHARQRRP QAHAALNLPG ARRQFGMRPV VHQVATEVTG 100
QLVAQQASLL GQHQAAQRAL EPVARPVDRC QPLGIGLGEG LRFVHAYLQR 150
LPLRGDGRRH DGKISNTMRQ . 171
```

Fig. 32I

1G2 SEQ ID NO:137

```
  1 NTTGTGTTAA  GATCAGGCTT  GGTGGTGAAG  AAAGGTTCGA  ACNNGTGGTC
 51 AATGATCNAC  TTCGGGGATN  CNGCTGCCCG  TATNATTCAA  CACGTGGTCA
101 AACGGTATGT  TCCGAGGCGT  CTGNCCACCN  GTACTAGTCG  ACGC
```

Fig. 33

CHORISMATE  ANTHRANILATE  PHENAZINE-1-CARBOXYLATE  PYOCYANIN

VIRULENCE-ASSOCIATED NUCLEIC ACID SEQUENCES AND USES THEREOF

CROSS REFERENCE TO RELATED APPLICATIONS

This application claims benefit from U.S. provisional application Ser. No. 60/066,517 which was filed on Nov. 25, 1997.

BACKGROUND OF THE INVENTION

This invention relates to nucleic acid molecules, genes, and polypeptides that are related to microbial pathogenicity.

Pathogens employ a number of genetic strategies to cause infection and, occasionally, disease in their hosts. The expression of microbial pathogenicity is dependent upon complex genetic regulatory circuits. Knowledge of the themes in microbial pathogenicity is necessary for understanding pathogen virulence mechanisms and for the development of new "anti-virulence or anti-pathogenic" agents, which are needed to combat infection and disease.

In one particular example, the opportunistic human pathogen, *Pseudomonas aeruginosa*, is a ubiquitous gram-negative bacterium isolated from soil, water, and plants (Palleroni, J. N. In: *Bergey's Manual of Systematic Bacteriology*, ed., J. G. Holt, Williams & Wilkins, Baltimore, Md., pp. 141–172, 1984). A variety of *P. aeruginosa* virulence factors have been described and the majority of these, such as exotoxin A, elastase, and phospholipase C, were first detected biochemically on the basis of their cytotoxic activity (Fink, R. B., *Pseudomonas aeruginosa the Opportunist: Pathogenesis and Disease*, Boca Raton, CRC Press Inc., 1993). Subsequently, the genes corresponding to these factors or genes that regulate the expression of these factors were identified. In general, most pathogenicity-related genes in mammalian bacterial pathogens were first detected using a bio-assay. In contrast to mammalian pathogens, simple systematic genetic strategies have been routinely employed to identify pathogenicity-related genes in plant pathogens. Following random transposon-mediated mutagenesis, thousands of mutant clones of the phytopathogen are inoculated separately into individual plants to determine if they contain a mutation that affects the pathogenic interaction with the host (Boucher et al., *J. Bacteriol.* 168:5626–5623, 1987; Comai and Kosuge, *J. Bacteriol.* 149:40–46, 1982; Lindgren et al., *J. Bacteriol.* 168:512–522, 1986; Rahme et al., *J. Bacteriol.* 173:575–586, 1991; Willis et al., *Mol. Plant-Microbe Interact.* 3:149–156, 1990). Comparable experiments using whole-animal mammalian pathogenicity models are not feasible because of the vast numbers of animals that must be subjected to pathogenic attack.

SUMMARY OF THE INVENTION

We have identified and characterized a number of nucleic acid molecules, polypeptides, and small molecules (e.g., phenazines) that are involved in conferring pathogenicity and virulence to a pathogen. This discovery therefore provides a basis for drug-screening assays aimed at evaluating and identifying "anti-virulence" agents which are capable of blocking pathogenicity and virulence of a pathogen, e.g., by selectively switching pathogen gene expression on or off, or which inactivate or inhibit the activity of a polypeptide which is involved in the pathogenicity of a microbe. Drugs that target these molecules are useful as such anti-virulence agents.

In one aspect, the invention features an isolated nucleic acid molecule including a sequence substantially identical to any one of BI48 (SEQ ID NO:1), ORF2 (SEQ ID NO:2), ORF3 (SEQ ID NO:4), ORF602c (SEQ ID NO:6), ORF214 (SEQ ID NO:8), ORF1242c (SEQ ID NO:10), ORF594 (SEQ ID NO:12), ORF1040 (SEQ ID NO:14), ORF1640c (SEQ ID NO:16), ORF2228c (SEQ ID NO:18), ORF2068c (SEQ ID NO:20), ORF1997 (SEQ ID NO:22), ORF2558c (SEQ ID NO:24), ORF2929c (SEQ ID NO:26), ORF3965c (SEQ ID NO:28), ORF3218 (SEQ ID NO:30), ORF3568 (SEQ ID NO:32), ORF4506c (SEQ ID NO:34), ORF3973 (SEQ ID NO:36), ORF4271 (SEQ ID NO:38), ORF4698 (SEQ ID NO:40), ORF5028 (SEQ ID NO:42), ORF5080 (SEQ ID NO:44), ORF6479c (SEQ ID NO:46), ORF5496 (SEQ ID NO:48), ORF5840 (SEQ ID NO:50), ORF5899 (SEQ ID NO:52), ORF6325 (SEQ ID NO:54), ORF7567c (SEQ ID NO:56), ORF7180 (SEQ ID NO:58), ORF7501 (SEQ ID NO:60), ORF7584 (SEQ ID NO:62), ORF8208c (SEQ ID NO:64), ORF8109 (SEQ ID NO:66), ORF9005Sc (SEQ ID NO:68), ORF8222 (SEQ ID NO:70), ORF8755c (SEQ ID NO:72), ORF9431c (SEQ ID NO:74), ORF9158 (SEQ ID NO:76), ORF10125c (SEQ ID NO:78), ORF9770 (SEQ ID NO:80), ORF9991 (SEQ ID NO82), ORF10765c (SEQ ID N0:84), ORF10475 (SEQ ID NO:86), ORF11095c (SEQ ID NO:88), ORF11264 (SEQ ID NO:90), ORF11738 (SEQ ID NO:92), ORF12348c (SEQ ID NO:94), ORF12314c (SEQ ID NO:96), ORF13156c (SEQ ID NO:98), ORF12795 (SEQ ID NO:100), ORF13755c (SEQ ID NO:210), ORF13795c (SEQ ID NO:212), ORF14727c (SEQ ID NO:214), ORF13779 (SEQ ID NO:216), ORF14293c (SEQ ID NO:218), ORF14155 (SEQ ID NO:220), ORF14360 (SEQ ID NO:222), ORF15342c (SEQ ID NO:224), ORF15260c (SEQ ID NO:226), ORF14991 (SEQ ID NO:228), ORF15590c (SEQ ID NO:230), ORF15675c (SEQ ID NO:232), ORF16405 (SEQ ID NO:234), ORF16925 (SEQ ID NO:236), ORF17793c (SEQ ID NO:238), ORF18548c (SEQ ID NO:240), ORF17875 (SEQ ID NO:242), ORF18479 (SEQ ID NO:244), ORF19027c (SEQ ID NO:246), ORF19305 (SEQ ID NO:248), ORF19519 (SEQ ID NO:250), ORF19544 (SEQ ID NO:252), ORF20008 (SEQ ID NO:254), ORF20623c (SEQ ID NO:256), ORF21210c (SEQ ID NO:258), ORF21493c (SEQ ID NO:260), ORF21333 (SEQ ID NO:262), ORF22074c (SEQ ID NO:264), ORF21421 (SEQ ID NO:266), ORF22608c (SEQ ID NO:268), ORF22626 (SEQ ID NO:270), ORF23228 (SEQ ID NO:272), ORF23367 (SEQ ID NO:274), ORF25103c (SEQ ID NO:276), ORF23556 (SEQ ID NO:278), ORF26191c (SEQ ID NO:280), ORF23751 (SEQ ID NO:282), ORF24222 (SEQ ID NO:284), ORF24368 (SEQ ID NO:286), ORF24888c (SEQ ID NO:288), ORF25398c (SEQ ID NO:290), ORF25892c (SEQ ID NO:292), ORF25110 (SEQ ID NO:294), ORF25510 (SEQ ID NO:296), ORF26762c (SEQ ID NO:298), ORF26257 (SEQ ID NO:300), ORF26844c (SEQ ID NO:302), ORF26486 (SEQ ID NO:304), ORF26857c (SEQ ID NO:306), ORF27314c (SEQ ID NO:308), ORF27730c (SEQ ID NO:310), ORF26983 (SEQ ID NO:312), ORF28068c (SEQ ID NO:314), ORF27522 (SEQ ID NO:316), ORF28033c (SEQ ID NO:318), ORF29701c (SEQ ID NO:320), ORF28118 (SEQ ID NO:322), ORF28129 (SEQ ID NO:324), ORF29709c (SEQ ID NO:326), ORF29189 (SEQ ID NO:328), ORF29382 (SEQ ID NO:330), ORF30590c (SEQ ID NO:332), ORF29729 (SEQ ID NO:334), ORF30221 (SEQ ID NO:336), ORF30736c (SEQ ID NO:338), ORF30539 (SEQ ID NO:340), ORF31247c (SEQ ID NO:342), ORF39063c (SEQ ID NO:344), ORF31539c (SEQ ID NO:346), ORF31222 (SEQ ID NO:348), ORF31266 (SEQ ID NO:350), ORF31661c (SEQ ID NO:352), ORF32061c (SEQ ID NO:354), ORF32072c (SEQ ID NO:356), ORF31784 (SEQ ID NO:358), ORF32568c (SEQ ID NO:360), ORF33157c (SEQ ID NO:362), ORF32530 (SEQ ID NO:364), ORF33705c (SEQ ID NO:366), ORF32832 (SEQ ID NO:368), ORF33547c (SEQ ID NO:370), ORF33205 (SEQ ID NO:372), ORF33512 (SEQ ID NO:374), ORF33771 (SEQ ID NO:376), ORF34385c (SEQ ID NO:378), ORF33988 (SEQ ID NO:380), ORF34274 (SEQ ID NO:382), ORF34726c (SEQ ID NO:384), ORF34916 (SEQ ID NO:386), ORF35464c (SEQ ID NO:388), ORF35289 (SEQ ID NO:390), ORF35410 (SEQ ID NO:392), ORF35907c (SEQ ID NO:394),ORF35534 (SEQ ID NO:396), ORF35930 (SEQ ID NO:398), ORF36246 (SEQ ID NO:400), ORF26640c (SEQ ID NO:402), ORF36769 (SEQ ID NO:404), ORF37932c (SEQ ID NO:406), ORF38640c (SEQ ID NO:408), ORF39309c (SEQ ID NO:410), ORF38768 (SEQ ID NO:412), ORF40047c (SEQ ID NO:414), ORF40560c (SEQ ID NO:416), ORF40238 (SEQ ID NO:418), ORF40329 (SEQ ID NO:420), QRF40709c (SEQ ID NO:422), ORF40507 (SEQ ID NO:424), ORF41275c (SEQ ID NO:426), ORF42234c (SEQ ID NO:428), ORF41764c (SEQ ID NO:430), ORF41284 (SEQ ID NO:432), ORF41598 (SEQ ID NO:434), ORF42172c (SEQ ID NO:436), ORF42233c (SEQ ID NO:451), 33A9 (SEQ ID NO:102, 189, 190, 191, 192, 193, 194, 195, 196, 197, and 198), 34B12 (SEQ ID NO:104), 34B12-ORF1 (SEQ ID NO:105), 34B12-ORF2 SEQ ID NO:106), 36A4 (SEQ ID NO:109), 36A4 contig (SEQ ID NO:111), 23A2 (SEQ ID NO:112), 3E8 phn(–)(SEQ ID NO:114), 3E8 contigPAO1 (SEQ ID NO:115), 34H4 (SEQ ID NO:118), 33C7 (SEQ ID NO:119), 25a12.3 (SEQ ID NO:120), 8C12 (SEQ ID NO:121), 2A8 (SEQ ID NO:122), 41A5 (SEQ ID NO:123), 50E12 (SEQ ID NO:124), 35A9 (SEQ ID NO:125), pho23 (SEQ ID NO:126), 16G12 (SEQ ID NO:127), 25F1 (SEQ ID NO:128), PA14 degP (SEQ ID NO:131), 1126 contig (SEQ ID NO:135), contig 1344 (SEQ ID NO:136), ORFA (SEQ ID NO:153), ORFB (SEQ ID NO:154), ORFC (SEQ ID NO:155), phzR (SEQ ID NO:164, and 1G2 (SEQ ID NO:137). Preferably, the isolated nucleic acid molecule includes any of the above-described sequences or a fragment thereof; and is derived from a pathogen (e.g., from a bacterial pathogen such as *Pseudomonas aeruginosa*). Additionally, the invention includes a vector and a cell, each of which includes at least one of the isolated nucleic acid molecules of the invention; and a method of producing a recombinant polypeptide involving providing a cell transformed with a nucleic acid molecule of the invention positioned for expression in the cell, culturing the transformed cell under conditions for expressing the nucleic acid molecule, and isolating a recombinant polypeptide. The invention further features recombinant polypeptides produced by such expression of an isolated nucleic acid molecule of the invention, and substantially pure antibodies that specifically recognize and bind such a recombinant polypeptides.

In an another aspect, the invention features a substantially pure polypeptide including an amino acid sequence that is substantially identical to the amino acid sequence of any one of ORF2 (SEQ ID NO:3), ORF3 (SEQ ID NO:5), ORF602c (SEQ ID NO:7), ORF214 (SEQ ID NO:9), ORF1242c (SEQ ID NO:11), ORF594 (SEQ ID NO:13), ORF1040 (SEQ ID NO:15), ORF1640c (SEQ ID NO:17), ORF2228c (SEQ ID NO:19), ORF2068c (SEQ ID NO:21), ORF1997 (SEQ ID NO:23), ORF2558c (SEQ ID NO:25), ORF2929c (SEQ ID NO:27), ORF3965c (SEQ ID NO:29), ORF3218 (SEQ ID NO:31), ORF3568 (SEQ ID NO:33), ORF4506c (SEQ ID NO:35), ORF3973 (SEQ ID NO:37), ORF4271 (SEQ ID NO:39), ORF4698 (SEQ ID NO:41), ORF5028 (SEQ ID NO:43), ORF5080 (SEQ ID NO:45), ORF6479c (SEQ ID NO:47), ORF5496 (SEQ ID NO:49), ORF5840 (SEQ ID NO:51), ORF5899 (SEQ ID NO:53), ORF6325 (SEQ ID NO:55), ORF7567c (SEQ ID NO:57), ORF7180 (SEQ ID NO:59), ORF7501 (SEQ ID NO:61), ORF7584 (SEQ ID NO:63), ORF8208c (SEQ ID NO:65), ORF8109 (SEQ ID NO:67), ORF9005c (SEQ ID NO:69), ORF8222 (SEQ ID NO:71), ORF8755c (SEQ ID NO:73), ORF9431c (SEQ ID NO:75), ORF9158 (SEQ ID NO:77), ORF10125c (SEQ ID NO:79), ORF9770 (SEQ ID NO:81), ORF9991 (SEQ ID NO:83), ORF10765c (SEQ ID NO:85), ORF10475 (SEQ ID NO:87), ORF11095c (SEQ ID NO:89), ORF11264 (SEQ ID NO:91), ORF11738 (SEQ ID NO:93), ORF12348c (SEQ ID NO:95), ORF12314c (SEQ ID NO:97), ORF13156c (SEQ ID NO:99), ORF12795 (SEQ ID NO:101), ORF13755c (SEQ ID NO:211), ORF13795c (SEQ ID NO:213), ORF14727c (SEQ ID NO:215), ORF13779 (SEQ ID NO:217), ORF14293c (SEQ ID NO:219), ORF14155 (SEQ ID NO:221), ORF14360 (SEQ ID NO:223), ORF15342c (SEQ ID NO:225), ORF15260c (SEQ ID NO:227), ORF14991 (SEQ ID NO:229), ORF15590c (SEQ ID NO:231), ORF15675c (SEQ ID NO:233), ORF16405 (SEQ ID NO:235), ORF16925 (SEQ ID NO:237), ORF17793c (SEQ ID NO:239), ORF18548c (SEQ ID NO:241), ORF17875 (SEQ ID NO:243), ORF18479 (SEQ ID NO:245), ORF19027c (SEQ ID NO:247), ORF19305 (SEQ ID NO:249), ORF19519 (SEQ ID NO:251), ORF19544 (SEQ ID NO:253), ORF20008 (SEQ ID NO:255), ORF20623c (SEQ ID NO:257), ORF21210c (SEQ ID NO:259), ORF21493c (SEQ ID NO:261), ORF21333 (SEQ ID NO:263), ORF22074c (SEQ ID NO:265), ORF21421 (SEQ ID NO:267), ORF22608c (SEQ ID NO:269), ORF22626 (SEQ ID NO:271), ORF23228 (SEQ ID NO:273), ORF23367 (SEQ ID NO:275), ORF25103c (SEQ ID NO:277), ORF23556 (SEQ ID NO:279), ORF26191c (SEQ ID NO:281), ORF23751 (SEQ ID NO:283), ORF24222 (SEQ ID NO:285), ORF24368 (SEQ ID NO:287), ORF24888c (SEQ ID NO:289), ORF25398c (SEQ ID NO:291), ORF25892c (SEQ ID NO:293), ORF25110 (SEQ ID NO:295), ORF25510 (SEQ ID NO:297), ORF26762c (SEQ ID NO:299), ORF26257 (SEQ ID NO:301), ORF26844c (SEQ ID NO:303), ORF26486 (SEQ ID NO:305), ORF26857c (SEQ ID NO:307), ORF27314c (SEQ ID NO:309), ORF27730c (SEQ ID NO:311), ORF26983 (SEQ ID NO:313), ORF28068c (SEQ ID NO:315), ORF27522 (SEQ ID NO:317), ORF28033c (SEQ ID NO:319), ORF29701c (SEQ ID NO:321), ORF28118 (SEQ ID NO:323), ORF28129 (SEQ ID NO:325), ORF29709c (SEQ ID NO:327), ORF29189 (SEQ ID NO:329), ORF29382 (SEQ ID NO:331), ORF30590c (SEQ ID NO:333), ORF29729 (SEQ ID NO:335), ORF30221 (SEQ ID NO:337), ORF30736c (SEQ ID NO:339), ORF30539 (SEQ ID NO:341), ORF31247c (SEQ ID NO:343), ORF30963c (SEQ ID NO:345), ORF31539c (SEQ ID NO:347), ORF31222 (SEQ ID NO:349), ORF31266 (SEQ ID NO:351), ORF31661c (SEQ ID NO:353), ORF32061c (SEQ ID NO:355), ORF32072c (SEQ ID NO:357), ORF31784 (SEQ ID NO:359), ORF32568c (SEQ ID NO:361), ORF33157c (SEQ ID NO:363), ORF32530 (SEQ ID NO:365), ORF33705c (SEQ ID NO:367), ORF32832 (SEQ ID NO:369), ORF33547c (SEQ ID NO:371), ORF33205 (SEQ ID NO:373), ORF33512 (SEQ ID NO:375), ORF33771 (SEQ ID NO:377), ORF34385c (SEQ ID NO:379), ORF33988 (SEQ ID NO:381), ORF34274 (SEQ ID NO:383), ORF34726c (SEQ ID NO:385), ORF34916 (SEQ ID NO:387), ORF35464c (SEQ ID NO:389), ORF35289 (SEQ ID NO:391), ORF35410 (SEQ ID NO:393), ORF35907c (SEQ ID NO:395), ORF35534 (SEQ ID NO:397), ORF35930 (SEQ ID NO:399), ORF36246 (SEQ ID NO:401), ORF26640c (SEQ ID NO:403), ORF36769 (SEQ ID NO:405), ORF37932c (SEQ ID NO:407), ORF38640c (SEQ ID NO:409), ORF39309c (SEQ ID NO:41 1), ORF38768 (SEQ ID NO:413), ORF40047c (SEQ ID NO:415), ORF40560c (SEQ ID NO:417), ORF40238 (SEQ ID NO:419), ORF40329 (SEQ ID NO:421), ORF40709c (SEQ ID NO:423), ORF40507 (SEQ ID NO:425), ORF41275c (SEQ ID NO:427), ORF42234c (SEQ ID NO:429), ORF41764c (SEQ ID NO:431), ORF41284 (SEQ ID NO:433), ORF41598 (SEQ ID NO:435), ORF42172c (SEQ ID NO:437), ORF42233c (SEQ ID NO:152), 33A9 (SEQ ID NOS:103, 199, 200, 201, 202, 203, 204, 205, 206, 207, and 208), 34B12-ORFJ (SEQ ID NO:107), 34B12-ORF2 (SEQ ID NO:108), 36A4 (SEQ ID NO:110), 3E8phzA (SEQ ID NO:116), 3E8phzB (SEQ ID NO:117), PhzR (SEQ ID NO:165), ORFA (SEQ ID NO:156), ORFB (SEQ ID NO:157), ORFC (SEQ ID NO:158), and PA14 degP (SEQ ID NO:132). Preferably, the substantially pure polypeptide includes any of the above-described sequences of a fragment thereof; and is derived from a pathogen (e.g., from a bacterial pathogen such as *Pseudomonas aeruginosa*).

In yet another related aspect, the invention features a method for identifying a compound which is capable of decreasing the expression of a pathogenic virulence factor (e.g., at the transcriptional or post-transcriptional levels), involving (a) providing a pathogenic cell expressing any one of the isolated nucleic acid molecules of the invention; and (b) contacting the pathogenic cell with a candidate compound, a decrease in expression of the nucleic acid molecule following contact with the candidate compound identifying a compound which decreases the expression of a pathogenic virulence factor. In preferred embodiments, the pathogenic cell infects a mammal (e.g., a human) or a plant.

In yet another related aspect, the invention features a method for identifying a compound which binds a polypeptide, involving (a) contacting a candidate compound with a substantially pure polypeptide including any one of the amino acid sequences of the invention under conditions that allow binding; and (b) detecting binding of the candidate compound to the polypeptide.

In addition, the invention features a method of treating a pathogenic infection in a mammal, involving (a) identifying a mammal having a pathogenic infection; and (b) administering to the mammal a therapeutically effective amount of a composition which inhibits the expression or activity of a polypeptide encoded by any one of the nucleic acid molecules of the invention. In preferred embodiments, the pathogen is *Pseudomonas aeruginosa*.

In yet another aspect, the invention features a method of treating a pathogenic infection in a mammal, involving (a) identifying a mammal having a pathogenic infection; and (b) administering to the mammal a therapeutically effective amount of a composition which binds and inhibits a polypeptide encoded by any one of the amino acid sequences of the invention. In preferred embodiments, the pathogenic infection is caused by *Pseudomonas aeruginosa*.

Moreover, the invention features a method of identifying a compound which inhibits the virulence of a Pseudomonas cell, involving (a) providing a Pseudomonas cell; (b) contacting the cell with a candidate compound; and (c) detecting the presence of a phenazine, wherein a decrease in the phenazine relative to an untreated control culture is an indication that the compound inhibits the virulence of the Pseudomonas cell. In preferred embodiments, the cell is *Pseudomonas aeruginosa*; the cell is present in a cell culture; and the phenazine is detected by spectroscopy (e.g., pyocyanin is detected at an absorbance of 520 nm). Pyocyanin is generally detected according to any standard method, e.g., those described herein.

By "isolated nucleic acid molecule" is meant a nucleic acid (e.g., a DNA) that is free of the genes which, in the naturally-occurring genome of the organism from which the nucleic acid molecule of the invention is derived, flank the gene. The term therefore includes, for example, a recombinant DNA that is incorporated into a vector; into an autonomously replicating plasmid or virus; or into the genomic DNA of a prokaryote or eukaryote; or that exists as a separate molecule (for example, a cDNA or a genomic or cDNA fragment produced by PCR or restriction endonuclease digestion) independent of other sequences. In addition, the term includes an RNA molecule which is transcribed from a DNA molecule, as well as a recombinant DNA which is part of a hybrid gene encoding additional polypeptide sequence.

By "polypeptide" is meant any chain of amino acids, regardless of length or post-translational modification (for example, glycosylation or phosphorylation).

By a "substantially pure polypeptide" is meant a polypeptide of the invention that has been separated from components which naturally accompany it. Typically, the polypeptide is substantially pure when it is at least 60%, by weight, free from the proteins and naturally-occurring organic molecules with which it is naturally associated. Preferably, the preparation is at least 75%, more preferably at least 90%, and most preferably at least 99%, by weight, a polypeptide of the invention. A substantially pure polypeptide of the invention may be obtained, for example, by extraction from a natural source (for example, a pathogen); by expression of a recombinant nucleic acid encoding such a polypeptide; or by chemically synthesizing the protein. Purity can be measured by any appropriate method, for example, column chromatography, polyacrylamide gel electrophoresis, or by HPLC analysis.

By "substantially identical" is meant a polypeptide or nucleic acid molecule exhibiting at least 25% identity to a reference amino acid sequence (for example, any one of the amino acid sequences described herein) or nucleic acid sequence (for example, any one of the nucleic acid sequences described herein). Preferably, such a sequence is at least 30%, 40%, 50%, 60%, more preferably 80%, and most preferably 90% or even 95% identical at the amino acid level or nucleic acid to the sequence used for comparison.

Sequence identity is typically measured using sequence analysis software (for example, Sequence Analysis Software Package of the Genetics Computer Group, University of Wisconsin Biotechnology Center, 1710 University Avenue, Madison, Wis. 53705, BLAST, BESTFIT, GAP, or PILEUP/PRETTYBOX programs). Such software matches identical or similar sequences by assigning degrees of homology to various substitutions, deletions, and/or other modifications. Conservative substitutions typically include substitutions within the following groups: glycine, alanine; valine, isoleucine, leucine; aspartic acid, glutamic acid, asparagine, glutamine; serine, threonine; lysine, arginine; and phenylalanine, tyrosine. In an exemplary approach to determining the degree of identity, a BLAST program may be used, with a probability score between $e^{-3}$ and $e^{-100}$ indicating a closely related sequence.

By "transformed cell" is meant a cell into which (or into an ancestor of which) has been introduced, by means of recombinant DNA techniques, a DNA molecule encoding (as used herein) a polypeptide of the invention.

By "positioned for expression" is meant that the DNA molecule is positioned adjacent to a DNA sequence which directs transcription and translation of the sequence (i.e., facilitates the production of, for example, a recombinant polypeptide of the invention, or an RNA molecule).

By "purified antibody" is meant antibody which is at least 60%, by weight, free from proteins and naturally-occurring organic molecules with which it is naturally associated. Preferably, the preparation is at least 75%, more preferably 90%, and most preferably at least 99%, by weight, antibody. A purified antibody of the invention may be obtained, for example, by affinity chromatography using a recombinantly-produced polypeptide of the invention and standard techniques.

By "specifically binds" is meant a compound or antibody which recognizes and binds a polypeptide of the invention but which does not substantially recognize and bind other molecules in a sample, for example, a biological sample, which naturally includes a polypeptide of the invention.

By "derived from" is meant isolated from or having the sequence of a naturally-occurring sequence (e.g., a cDNA, genomic DNA, synthetic, or combination thereof).

By "inhibiting a pathogen" is meant the ability of a candidate compound to decrease, suppress, attenuate, diminish, or arrest the development or progression of a pathogen-mediated disease or an infection in a eukaryotic host organism. Preferably, such inhibition decreases pathogenicity by at least 5%, more preferably by at least 25%, and most preferably by at least 50%, as compared to symptoms in the absence of the candidate compound in any appropriate pathogenicity assay (for example, those assays described herein). In one particular example, inhibition may be measured by monitoring pathogenic symptoms in a host organism exposed to a candidate compound or extract, a decrease in the level of symptoms relative to the level of pathogenic symptoms in a host organism not exposed to the compound indicating compound-mediated inhibition of the pathogen.

By "pathogenic virulence factor" is meant a cellular component (e.g., a protein such as a transcription factor, as well as the gene which encodes such a protein) without which the pathogen is incapable of causing disease or infection in a eukaryotic host organism.

The invention provides a number of targets that are useful for the development of drugs that specifically block the pathogenicity of a microbe. In addition, the methods of the invention provide a facile means to identify compounds that are safe for use in eukaryotic host organisms (i.e., compounds which do not adversely affect the normal development and physiology of the organism), and efficacious against pathogenic microbes (i.e., by suppressing the virulence of a pathogen). In addition, the methods of the invention provide a route for analyzing virtually any number of compounds for an anti-virulence effect with high-volume throughput, high sensitivity, and low complexity.

The methods are also relatively inexpensive to perform and enable the analysis of small quantities of active substances found in either purified or crude extract form.

Other features and advantages of the invention will be apparent from the detailed description, and from the claims.

DETAILED DESCRIPTION

The drawings will first be described.

Drawings

FIGS. 2A–2K show the nucleotide sequence of cosmid BI48 (SEQ ID NO:1).

Figure 1A:
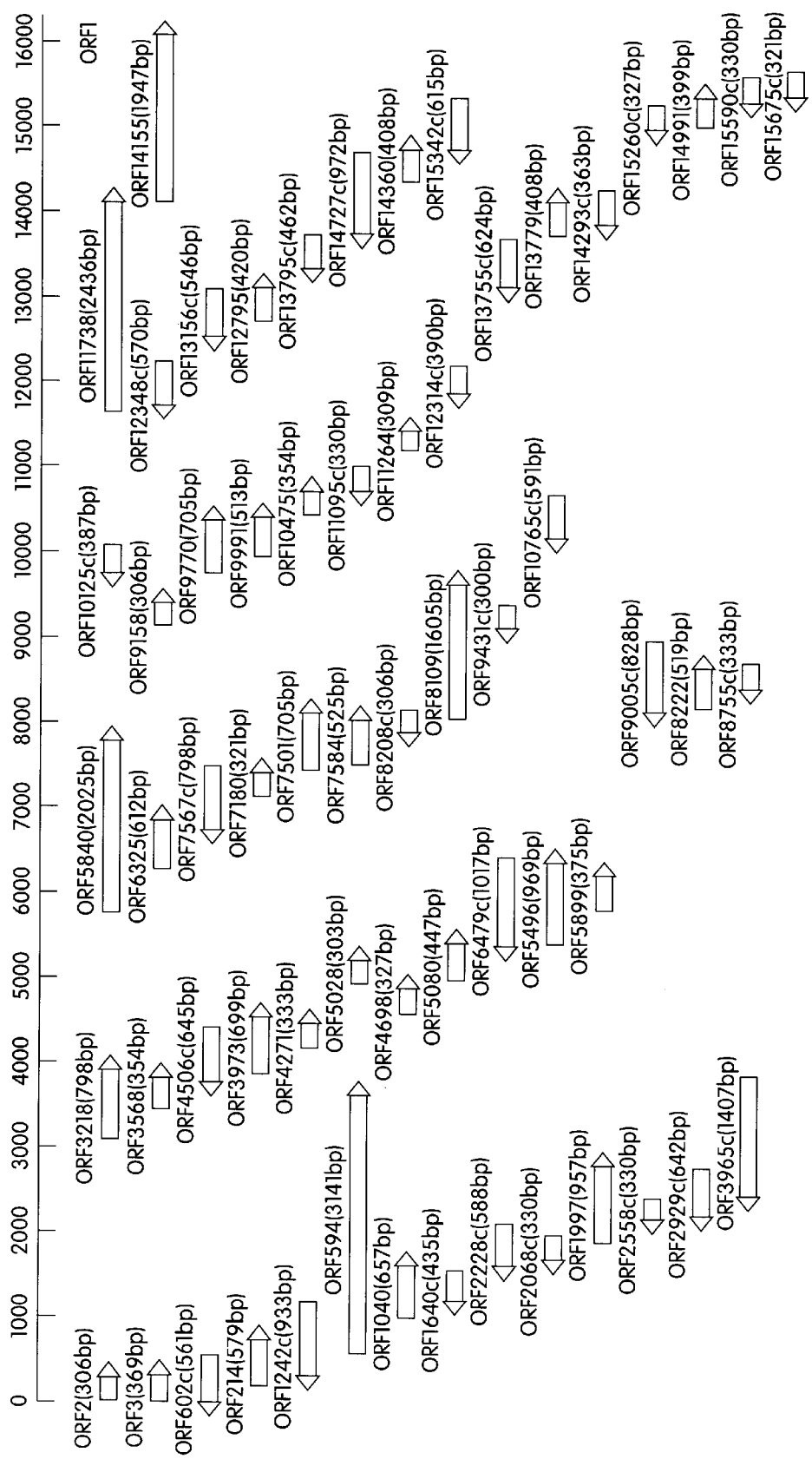
FIGS. 1A–1C are schematic diagrams showing the physical map of cosmid BI48 (SEQ ID NO:1) and the orientation of the identified open reading frames (ORFs).

FIGS. 3-1 to 3-39 shows the nucleotide sequences for ORF2 (SEQ ID NO:2), ORF3 (SEQ ID NO:4), ORF602c (SEQ ID NO:6), ORF214 (SEQ ID NO:8), ORF1242c (SEQ ID NO:10), ORF594 (SEQ ID NO:12), ORF1040 (SEQ ID NO:14), ORF1640c (SEQ ID NO:16), ORF2228c (SEQ ID NO:18), ORF2068c (SEQ ID NO:20), ORF1997 (SEQ ID NO:22), ORF2558c (SEQ ID NO:24), ORF2929c (SEQ ID NO:26), ORF3965c (SEQ ID NO:28), ORF3218 (SEQ ID NO:30), ORF3568 (SEQ ID NO:32), ORF4506c (SEQ ID NO:34), ORF3973 (SEQ ID NO:36), ORF4271 (SEQ ID NO:38), ORF4698 (SEQ ID NO:40), ORF5028 (SEQ ID NO:42), ORF5080 (SEQ ID NO:44), ORF6479c (SEQ ID NO:46), ORF5496 (SEQ ID NO:48), ORF5840 (SEQ ID NO:50), ORF5899 (SEQ ID NO:52), ORF6325 (SEQ ID NO:54), ORF7567c (SEQ ID NO:56), ORF7180 (SEQ ID NO:58), ORF7501 (SEQ ID NO:60), ORF7584 (SEQ ID NO:62), ORF8208c (SEQ ID NO:64), ORF8109 (SEQ ID NO:66), ORF9005c (SEQ ID NO:68), ORF8222 (SEQ ID NO:70), ORF8755c (SEQ ID NO:72), ORF9431c (SEQ ID NO:74), ORF9158 (SEQ ID NO:76), ORF10125c (SEQ ID NO:78), ORF9770 (SEQ ID NO:80), ORF9991 (SEQ ID NO:82), ORF10765c (SEQ ID NO:84), ORF10475 (SEQ ID NO:86), ORFI 1095c (SEQ ID NO:88), ORF11264 (SEQ ID NO:90), ORF11738 (SEQ ID NO:92), ORF12348c (SEQ ID NO:94), ORF12314c (SEQ ID NO:96), ORF13156c (SEQ ID NO:98), ORF12795 (SEQ ID NO:100), ORF13755c (SEQ ID NO:210), ORF13795c (SEQ ID NO:212), ORF14727c (SEQ ID NO:214), ORF13779 (SEQ ID NO:216), ORF14293c (SEQ ID NO:218), ORF14155 (SEQ ID NO:220), ORF14360 (SEQ ID NO:222), ORF15342c (SEQ ID NO:224), ORF15260c (SEQ ID NO:226), ORF14991 (SEQ ID NO:228), ORF15590c (SEQ ID NO:230), ORF15675c (SEQ ID NO:232), ORF16405 (SEQ ID NO:234), ORF16925 (SEQ ID NO:236), ORF17793c (SEQ ID NO:238), ORF18548c (SEQ ID NO:240), ORF17875 (SEQ ID NO:242), ORF18479 (SEQ ID NO:244), ORF19027c (SEQ ID NO:246), ORF19305 (SEQ ID NO:248), ORF19519 (SEQ ID NO:250), ORF19544 (SEQ ID NO:252), ORF20008 (SEQ ID NO:254), ORF20623c (SEQ ID NO:256), ORF21210c (SEQ ID NO:258), ORF21493c (SEQ ID NO:260), ORF21333 (SEQ ID NO:262), ORF22074c (SEQ ID NO:264), ORF21421 (SEQ ID NO:266), ORF22608c (SEQ ID NO:268), ORF22626 (SEQ ID NO:270), ORF23228 (SEQ ID NO:272),ORF23367 (SEQ ID NO:274), ORF25103c (SEQ ID NO:276), ORF23556 (SEQ ID NO:278), ORF26191c (SEQ ID NO:280), ORF23751 (SEQ ID NO:282), ORF24222 (SEQ ID NO:284), ORF24368 (SEQ ID NO:286), ORF24888c (SEQ ID NO:288), ORF25398c (SEQ ID NO:290), ORF25892c (SEQ ID NO:292), ORF25110 (SEQ ID NO:294), ORF25510 (SEQ ID NO:296), ORF26762c (SEQ ID NO:298), ORF26257 (SEQ ID NO:300), ORF26844c (SEQ ID NO:302), ORF26486 (SEQ ID NO:304), ORF26857c (SEQ ID NO:306), ORF27314c (SEQ ID NO:308), ORF27730c (SEQ ID NO:310), ORF26983 (SEQ ID NO:312), ORF28068c (SEQ ID NO:314), ORF27522 (SEQ ID NO:316), ORF28033c (SEQ ID NO:318), ORF29701c (SEQ ID NO:320), ORF28118 (SEQ ID NO:322), ORF28129 (SEQ ID NO:324), ORF29709c (SEQ ID NO:326), ORF29189 (SEQ ID NO:328), ORF29382 (SEQ ID NO:330), ORF30590c (SEQ ID NO:332), ORF29729 (SEQ ID NO:334), ORF30221 (SEQ ID NO:336), ORF30736c (SEQ ID NO:338), ORF30539 (SEQ ID NO:340), ORF31247c (SEQ ID NO:342), ORF31539c (SEQ ID NO:346), ORF31222 (SEQ ID NO:348), ORF31266 (SEQ ID NO:350), ORF31661c (SEQ ID NO:352), ORF32061c (SEQ ID NO:354), ORF32072c (SEQ ID NO:356), ORF31784 (SEQ ID NO:358), ORF32568c (SEQ ID NO:360), ORF33157c (SEQ ID NO:362), ORF32530 (SEQ ID NO:364), ORF33705c (SEQ ID NO:366), ORF32832 (SEQ ID NO:368), ORF33547c (SEQ ID NO:370), ORF33205 (SEQ ID NO:372), ORF33512 (SEQ ID NO:374), ORF33771 (SEQ ID NO:376), ORF34385c (SEQ ID NO:378), ORF33988 (SEQ ID NO:380), ORF34274 (SEQ ID NO:382), ORF34726c (SEQ ID NO:384), ORF34916 (SEQ ID NO:386), ORF35464c (SEQ ID NO:388), ORF35289 (SEQ ID NO:390), ORF35410 (SEQ ID NO:392), ORF35907c (SEQ ID NO:394), ORF35534 (SEQ ID NO:396), ORF35930 (SEQ ID NO:398), ORF36246 (SEQ ID NO:400), ORF26640c (SEQ ID NO:402), ORF36769 (SEQ ID NO:404), ORF37932c (SEQ ID NO:406), ORF38640c (SEQ ID NO:408), ORF39309c (SEQ ID NO:410), ORF38768 (SEQ ID NO:412), ORF40047c (SEQ ID NO:414), ORF40560c (SEQ ID NO:416), ORF40238 (SEQ ID NO:418), ORF40329 (SEQ ID NO:420), ORF40709c (SEQ ID NO:422), ORF40507 (SEQ ID NO:424), ORF41275c (SEQ ID NO:426), ORF42234c (SEQ ID NO:428), ORF41764c (SEQ ID NO:430), ORF41284 (SEQ ID NO:432), ORF41598 (SEQ ID NO:434), ORF42172c (SEQ ID NO:436), and ORF42233c (SEQ ID NO:151).

FIGS. 4–1 to 4–22 shows the deduced amino acid sequences for ORF2 (SEQ ID NO:3), ORF3 (SEQ ID NO:5), ORF602c (SEQ ID NO:7), ORF214 (SEQ ID NO:9), ORF1242c (SEQ ID NO:11), ORF594 (SEQ ID NO:13), ORF1040 (SEQ ID NO:15), ORF1640c (SEQ ID NO:17), ORF2228c (SEQ ID NO:19), ORF2068c (SEQ ID NO:21), ORF1997 (SEQ ID NO:23), ORF2558c (SEQ ID NO:25), ORF2929c (SEQ ID NO:27), ORF3965c (SEQ ID NO:29), ORF3218 (SEQ ID NO:31), ORF3568 (SEQ ID NO:33), ORF4506c (SEQ ID NO:35), ORF3973 (SEQ ID NO:37), ORF4271 (SEQ ID NO:39), ORF4698 (SEQ ID NO:41), ORF5028 (SEQ ID NO:43), ORF5080 (SEQ ID NO:45), ORF6479c (SEQ ID NO:47), ORF5496 (SEQ ID NO:49), ORF5840 (SEQ ID NO:51), ORF5899 (SEQ ID NO:53), ORF6325 (SEQ ID NO:55), ORF7567c (SEQ ID NO:57), ORF7180 (SEQ ID NO:59), ORF7501 (SEQ ID NO:61), ORF7584 (SEQ ID NO:63), ORF8208c (SEQ ID NO:65), ORF8109 (SEQ ID NO:67), ORF9005c (SEQ ID NO:69), ORF8222 (SEQ ID NO:71), ORF8755c (SEQ ID NO:73), ORF9431c (SEQ ID NO:75), ORF9158 (SEQ ID NO:77), ORF10125c (SEQ ID NO:79), ORF9770 (SEQ ID NO:81), ORF9991 (SEQ ID NO:83), ORF10765c (SEQ ID NO:85), ORF10475 (SEQ ID NO:87), ORF11095c (SEQ ID NO:89), ORF11264 (SEQ ID NO:91), ORF11738 (SEQ ID NO:93), ORF12348c (SEQ ID NO:95), ORF12314c (SEQ ID NO:97), ORF13156c (SEQ ID NO:99), ORF12795 (SEQ ID NO:101), ORF13755c (SEQ ID NO:211), ORF13795c (SEQ ID NO:213), ORF14727c (SEQ ID NO:215), ORF13779 (SEQ ID NO:217), ORF14293c (SEQ ID NO:219), ORF14155 (SEQ ID NO:221), ORF14360 (SEQ ID NO:223), ORF15342c (SEQ ID NO:225), ORF15260c (SEQ ID NO:227), ORF14991 (SEQ ID NO:229), ORF15590c (SEQ ID NO:231), ORF15675c (SEQ ID NO:233), ORF16405 (SEQ ID NO:235), ORF16925 (SEQ ID NO:237), ORF17793c (SEQ ID NO:239), ORF18548c (SEQ ID NO:241), ORF17875 (SEQ ID NO:243), ORF18479 (SEQ ID NO:245), ORF19027c (SEQ ID NO:247), ORF19305 (SEQ ID NO:249), ORF19519 (SEQ ID NO:251), ORF19544 (SEQ ID NO:253), ORF20008 (SEQ ID NO:255), ORF20623c (SEQ ID NO:257), ORF21210c (SEQ ID NO:259), ORF21493c (SEQ ID NO:261), ORF21333 (SEQ ID NO:263), ORF22074c (SEQ ID NO:265), ORF21421 (SEQ ID NO:267), ORF22608c (SEQ ID NO:269), ORF22626 (SEQ ID NO:271), ORF23228 (SEQ ID NO:273), ORF23367 (SEQ ID NO:275), ORF25103c (SEQ ID NO:277), ORF23556 (SEQ ID NO:279), ORF26191c (SEQ ID NO:281), ORF23751 (SEQ ID NO:283), ORF24222 (SEQ ID NO:285), ORF24368 (SEQ ID NO:287), ORF24888c (SEQ ID NO:289), ORF25398c (SEQ ID NO:291), ORF25892c (SEQ ID NO:293), ORF25110 (SEQ ID NO:295), ORF25510 (SEQ ID NO:297), ORF26762c (SEQ ID NO:299), ORF26257 (SEQ ID NO:301), ORF26844c (SEQ ID NO:303), ORF26486 (SEQ ID NO:305), ORF26857c (SEQ ID NO:307), ORF27314c (SEQ ID NO:309), ORF27730c (SEQ ID NO:311), ORF26983 (SEQ ID NO:313), ORF28068c (SEQ ID NO:315), ORF27522 (SEQ ID NO:317), ORF28033c (SEQ ID NO:319), ORF29701c (SEQ ID NO:321), ORF28118 (SEQ ID NO:323), ORF28129 (SEQ ID NO:325), ORF29709c (SEQ ID NO:327), ORF29189 (SEQ ID NO:329), ORF29382 (SEQ ID NO:331), ORF30590c (SEQ ID NO:333), ORF29729 (SEQ ID NO:335), ORF30221 (SEQ ID NO:337), ORF30736c (SEQ ID NO:339), ORF30539 (SEQ ID NO:341), ORF31247c (SEQ ID NO:343), ORF30963c (SEQ ID NO:345), ORF31539c (SEQ ID NO:347), ORF31222 (SEQ ID NO:349), ORF31266 (SEQ ID NO:351), ORF31661c (SEQ ID NO:353), ORF32061c (SEQ ID NO:355), ORF32072c (SEQ ID NO:357), ORF31784 (SEQ ID NO:359), ORF32568c (SEQ ID NO:361), ORF33157c (SEQ ID NO:363), ORF32530 (SEQ ID NO:365), ORF33705c (SEQ ID NO:367), ORF32832 (SEQ ID NO:369), ORF33547c (SEQ ID NO:371), ORF33205 (SEQ ID NO:373), ORF33512 (SEQ ID NO:375), ORF33771 (SEQ ID NO:377), ORF34385c (SEQ ID NO:379), ORF33988 (SEQ ID NO:381), ORF34274 (SEQ ID NO:383), ORF34726c (SEQ ID NO:385), ORF34916 (SEQ ID NO:387), ORF35464c (SEQ ID NO:389), ORF35289 (SEQ ID NO:391), ORF35410 (SEQ ID NO:393), ORF35907c (SEQ ID NO:395), ORF35534 (SEQ ID NO:397), ORF35930 (SEQ ID NO:399), ORF36246 (SEQ ID NO:401), ORF26640c (SEQ ID NO:403), ORF36769 (SEQ ID NO:405), ORF37932c (SEQ ID NO:407), ORF38640c (SEQ ID NO:409), ORF39309c (SEQ ID NO:411), ORF38768 (SEQ ID NO:413), ORF40047c (SEQ ID NO:415), ORF40560c (SEQ ID NO:417), ORF40238 (SEQ ID NO:419), ORF40329 (SEQ ID NO:421), ORF40709c (SEQ ID NO:423), ORF40507 (SEQ ID NO:425), ORF41275c (SEQ ID NO:427), ORF42234c (SEQ ID NO:429), ORF41764c (SEQ ID NO:431), ORF41284 (SEQ ID NO:433), ORF41598 (SEQ ID NO:435), ORF42172c (SEQ ID NO:437), and ORF42233c (SEQ ID NO:152).

FIG. 5 shows the nucleotide sequence (SEQ ID NO:102) encoding a protein encoded by the 33A9 sequence.

FIG. 6A shows the deduced amino acid sequence (SEQ ID NO:103) a protein encoded by the 33A9 sequence.

FIGS. 6B–U shows the nucleotide sequences of several ORFs1–10 (SEQ ID NOS:189, 190, 191, 192, 193, 194, 195, 196, 197, and 198) identified in the 33A9 sequence and their respective amino acid sequences (ORFs1–10; SEQ ID NOS:199, 200, 201, 202, 203, 204, 205, 206, 207, and 208).

Figure 7A:
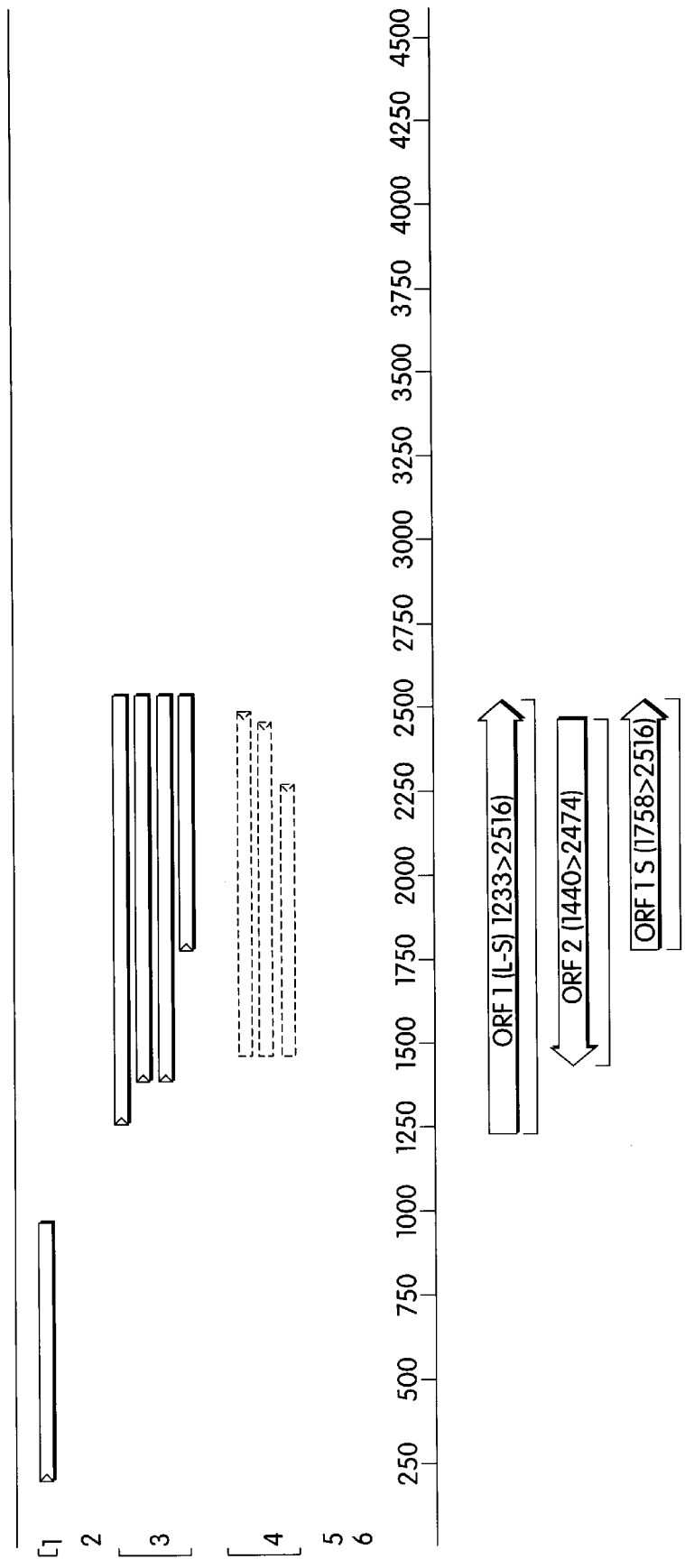

FIG. 7A shows the physical map of the 34B12 EcoR1 fragment map identifying the positions of three ORFs: ORF1 (L-S), ORF2, and ORF 1S. FIGS. 7B–7E show the nucleotide sequence corresponding to the pho34B12 insertion (SEQ ID NO: 104) containing ORF1 (L-S) (SEQ ID NO: 105 and 107), ORF2 (SEQ ID NOS: 106 and 108), and ORF 1 -S(SEQ ID NOS: 159 and 209). FIGS. 7F, 7H, and 7J, show the nucleotide sequences of ORF1(SEQ ID NO: 105), ORF2 (SEQ ID NO: 106), and ORF1-S (SEQ ID NO: 159), respectively. FIGS. 7G, 7I, and 7K show the protein sequences of ORF1 (L-S) (SEQ ID NO: 107), ORF2 (SEQ ID NO: 108), and ORF1-S (SEQ ID NO: 209), respectively.

FIG. 8 shows the deduced amino acid sequence of ORF1 (L-S) (SEQ ID NO:107) which is depicted in FIG. 7G.

FIG. 9 shows the deduced amino acid sequence of ORF2 (SEQ ID NO:108) which is depicted in FIG. 7I.

FIG. 10 shows the nucleotide sequence (SEQ ID NO:109) corresponding to the 36A4 insertion.

FIG. 11 shows the deduced amino acid sequence of the peptide (SEQ ID NO: 110) encoded by the 36A4 sequence. The predicted peptide encoded by the 36A4 sequence has homology to the hrpM gene of *Pseudomonas syringae* (Loubens, et al. *Mol. Microbiol.* 10: 329–340, 1993).

FIGS. 12A–C show the nucleotide sequence (SEQ ID NO:111) of contig 2507 identified using 36A4 nucleotide sequence.

FIG. 13 shows the nucleotide sequence (SEQ ID NO:112) corresponding to the 23A2 insertion.

FIG. 14A shows the deduced amino acid sequence of the peptide (SEQ ID NO: 113) encoded by the 23A2 sequence. The peptide predicted by the 23A2 sequence is homologous to a known protein in *Pseudomonas aeruginosa*. (strain CD10): the mexA gene. This gene is part of an operon that also contains two other genes: mexB and oprM (Poole et al., *Mol. Microbiol.* 10: 529–544, 1993); GenBank submission: L11616.

FIG. 14B shows the nucleotide sequence (SEQ ID NO:148) and FIGS. 14C and 14D show the predicted partial amino acid sequences of PA14 mexA and mexB (SEQ ID NOS: 149 and 150, respectively).

FIG. 15 shows the nucleotide sequence (SEQ ID NO:114) of the PAO1 phenazine operon that was identified using the 3E8 sequence tag.

FIG. 16A shows the nucleotide sequence (SEQ ID NO:115) of the 3E8 sequence tag.

FIG. 16B shows the nucleotide sequences flanking the 3E8 sequence tag (SEQ ID NO:160).

FIG. 17 shows the deduced 3E8 PHZA amino acid sequence (SEQ ID NO: 116).

FIG. 18A shows the deduced 3E8 PHZB amino acid sequence (SEQ ID NO: 117).

FIG. 18B shows the deduced 3E8 PHZA partial amino acid sequence (SEQ ID NO:161).

FIG. 18C shows the deduced 3E8 PHZB partial amino acid sequence (SEQ ID NO:162).

FIG. 18D shows the deduced 3E8 PHZC partial amino acid sequence (SEQ ID NO:163).

FIGS. 18E and 18F show the nucleotide sequence (SEQ ID NO:164) and predicted partial amino acid sequence (SEQ ID NO:165) of PA14phzR, respectively.

FIG. 19 shows the nucleotide sequence (SEQ ID NO:118) of the 34H4 sequence tag.

FIG. 20 shows the nucleotide sequence (SEQ ID NO:119) of the 33C7 sequence tag.

FIG. 21 shows the nucleotide sequence (SEQ ID NO:120) of the 25a12.3 sequence tag.

FIG. 22 shows the nucleotide sequence (SEQ ID NO:121) of the 8C12 sequence tag.

FIG. 23 shows the nucleotide sequence (SEQ ID NO:122) of the 2A8 sequence tag.

FIGS. 24A–F show the nucleotide sequences (SEQ ID NOS:123, 124, 125, 126, 127, and 128) of the 41A5, 50E12, 35A9, pho23, 16G12, and 25F1 TnphoA sequence tags, respectively.

FIG. 24G shows the nucleotide sequence (SEQ ID NO:166) and predicted amino acid sequence (SEQ ID NO:167) of PA14pho15.

FIGS. 24H and 24I show the nucleotide sequence (SEQ ID NO:168) of PA14 50E12 encoding YgdP$_{Pa}$ (SEQ ID NO:169) and PtSP$_{Pa}$ (SEQ ID NO:170).

FIG. 24J shows the nucleotide sequence (SEQ ID NO:171) of PA14 35A9 encoding mtrR$_{Pa}$ (SEQ ID NO:172).

FIGS. 24K and 24L show the nucleotide sequence (SEQ ID NO:173) of PA14 25F1 encoding ORFT (SEQ ID NO:174), ORFU (SEQ ID NO:175), and DjlA$_{Pa}$ (SEQ ID NO:176).

FIGS. 25A and 25B show the nucleotide sequence (SEQ ID NO:129) of the phnA and phnB genes of *Pseudomonas aerutginosa* of PAO1 and PA14.

FIG. 26 shows the deduced amino acid sequence (SEQ ID NO:130) of PHNA.

FIG. 27 shows the nucleotide sequence (SEQ ID NO:131) of the PA14 degP gene.

FIG. 28 shows the deduced amino acid sequence (SEQ ID NO:132) of the PA14 degP gene.

FIG. 29 shows the nucleotide sequence (SEQ ID NO:133) of the algD gene of *Pseudomonas aeruginosa* strain 8830.

FIG. 32A shows the physical map of the 1344 (SEQ ID NO:136) contig identified using 33C7 which illustrates three identified ORFs: ORFA (SEQ ID NO:153), ORFB (SEQ ID NO:154), and ORFC (SEQ ID NO:155). FIGS. 32B and 32C show the nucleotide sequence of 1344 (SEQ ID NO:136). FIGS. 32D, 32F, and 32H show the nucleotide sequence of ORFA (SEQ ID NO:153), ORFB (SEQ ID NO:154), and ORFC (SEQ ID NO:155), respectively. The amino acid sequences of ORFA (SEQ ID NO:156), ORFB (SEQ ID NO:157), and ORFC (SEQ ID NO:158) encoded by their respective ORFs are shown in FIGS. 32E, 32G, and 32I, respectively.

FIG. 33 shows the nucleotide sequence (SEQ ID NO:137) of the 1G2 sequence tag.

FIGS. 34A–D are graphs showing the complementation of the worm pathogenicity phenotype of 4 TnphoA mutants using the *C. elegans* slow-killing assay.

Figure 34A:
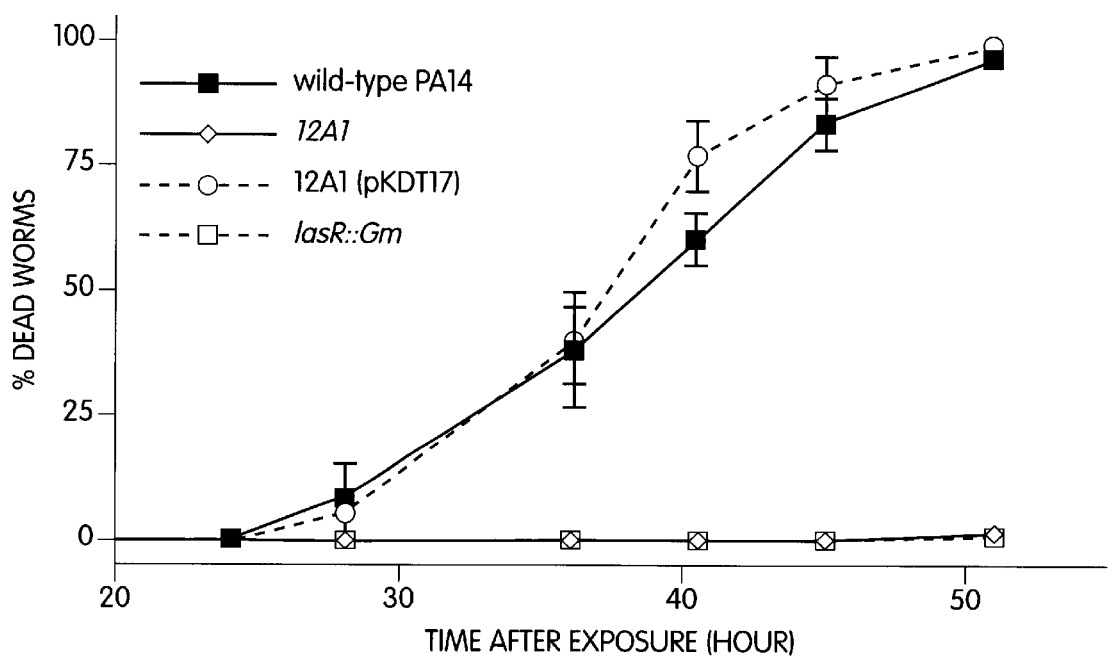

FIG. 34A is a graph showing that the nonpathogenic phenotype of mutant 12A1 (open diamonds) could be fully complemented to the wild-type PA14 levels (filled squares) by the lasR gene from PAO1 under the control of the constitutive lacZ promoter in trans in strain 12A1 (pKDT17) (open circles). The reconstructed lasR mutant, PA14 lasR-G (open squares) is as nonpathogenic as 12A1 (open diamonds). Results from an experiment using one-day-old adults is shown.

Figure 34B:
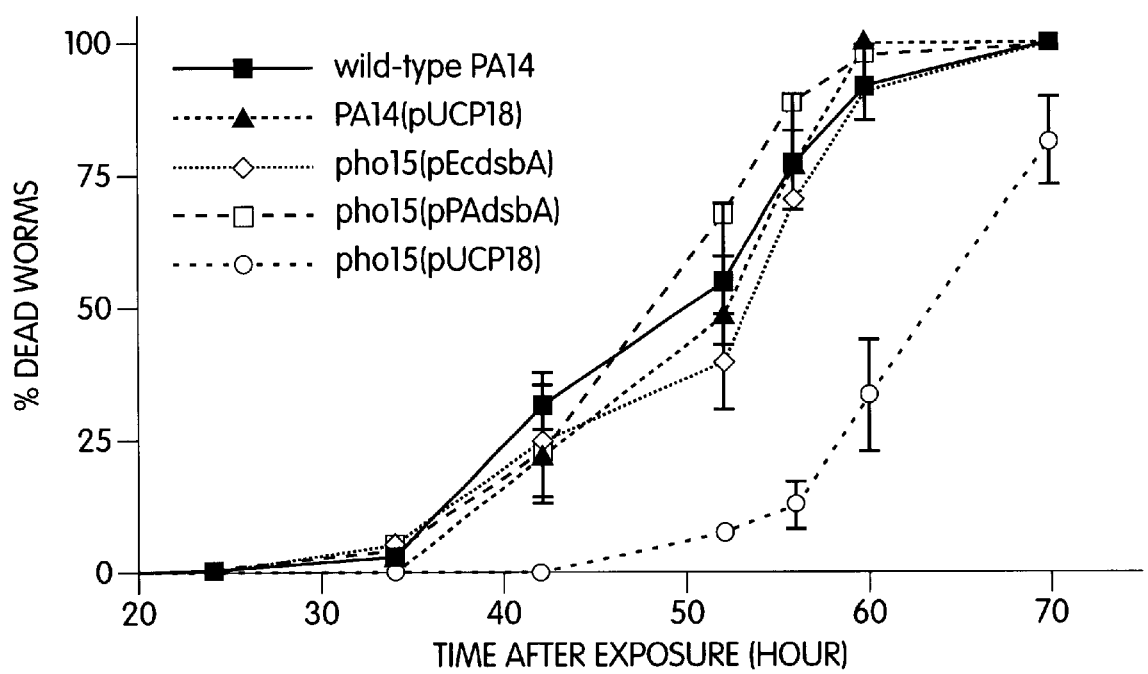

FIG. 34B is a graph showing the complementation of the delayed-killing phenotype of pho15. Strains pho15

(pEcdsbA) (open diamonds) and pho15(pPAdsbA), carry the dsbA gene from *E. coli* and *P. aeruginosa*, respectively, in trans under the control of the constitutive lacZ promoter.

Figure 34C:
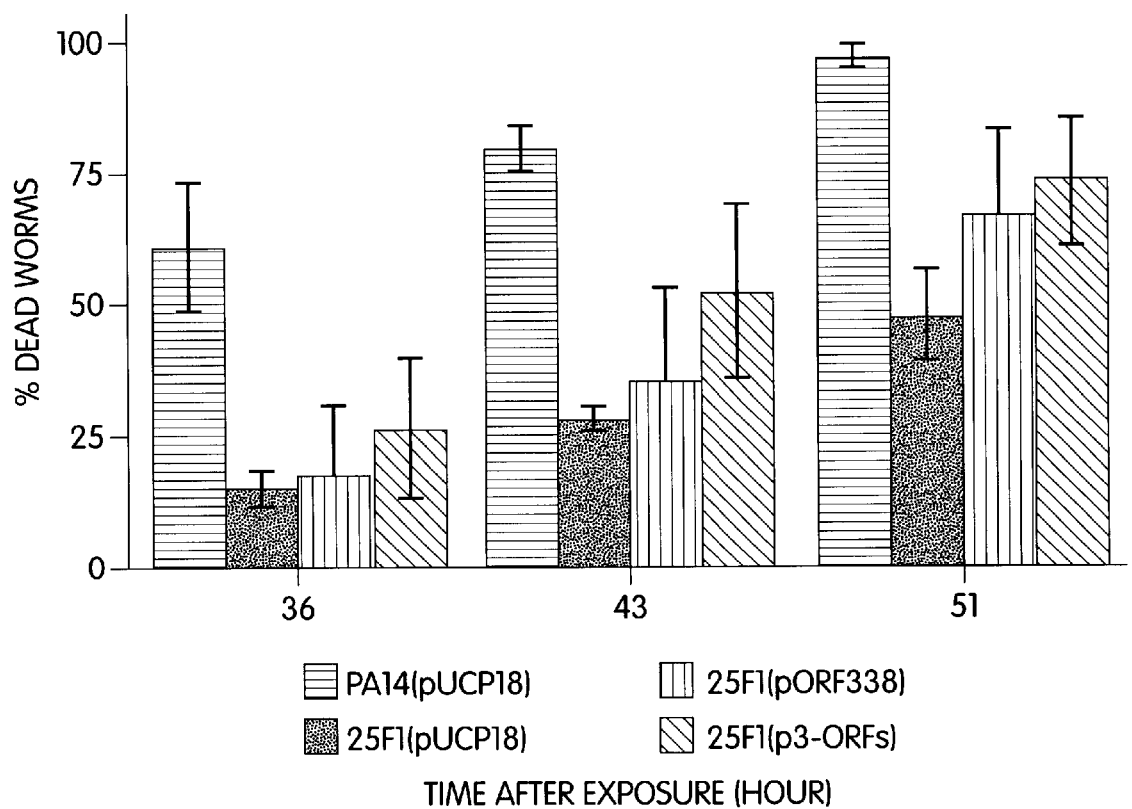

FIG. 34C is a graph showing that the delayed killing phenotype of 25F1 was only partially restored by strains 25F1(pORF338) and 25F1(p3-ORFs) carrying plasmids containing orf338 and orf338-orf224-djlA$_{Pa}$, respectively.

Figure 34D:
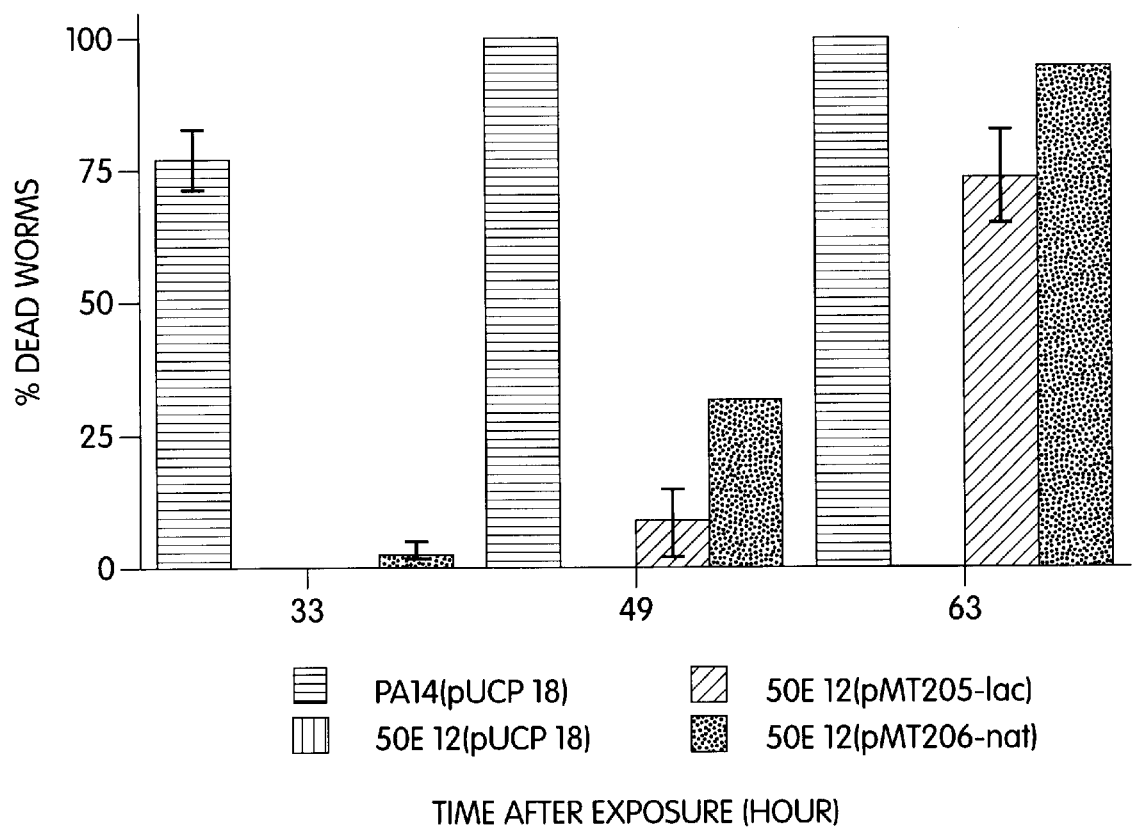

FIG. 34D is a graph showing the complementation of 50E12 by the orfp59-ptsP$_{Pa}$ operon. Strain 50e12(pUCP18), like mutant 12A1, does not kill worms even after 63 hours. Both strains 50E12(pMT205-lac) and 50E12(pMT206-nat), expressing the putative orfl59-ptsP$_{Pa}$ operon were able to kill *C. elegans*. In 50E12(pMT205-lac), transcription of orf159-ptsP$_{Pa}$ is under the control of the constitutive lacZ promoter, whereas in 50E12(pMT206-nat), the operon is controlled by its native promoter. Each data point represents means±SD of 3–4 replicates. Unless indicated otherwise, synchronized L4 worms were used in the experiments. At least two independent experiments were performed for each complementation analysis.

Figure 35A:
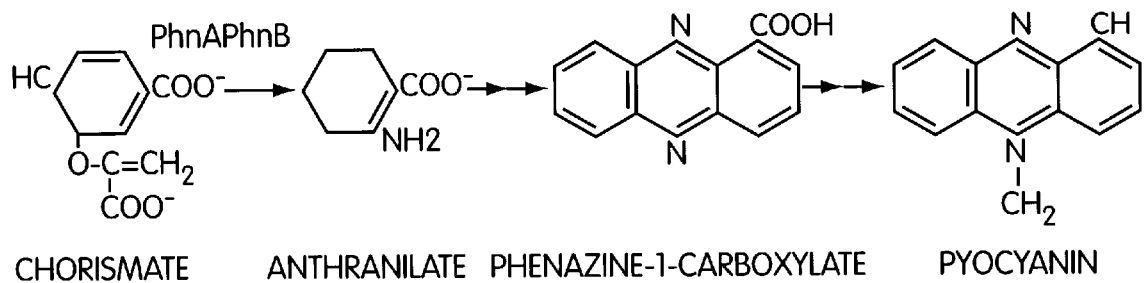

FIG. 35A is a schematic illustration showing the anthranilate synthase complex that is encoded by the phnA and phnB genes which catalyzes the conversion of chorismate to anthranilate. Antranilate serves as a precursor for pyocyanin production in *P. aeruginosa*, strain PAO1 (Essar et al., *J. Bacteriol.* 172: 884–900, 1990). The double arrows indicate the involvement of multiple, undefined steps, leading from the conversion of anthranilate to pyocyanin.

Figure 35B:
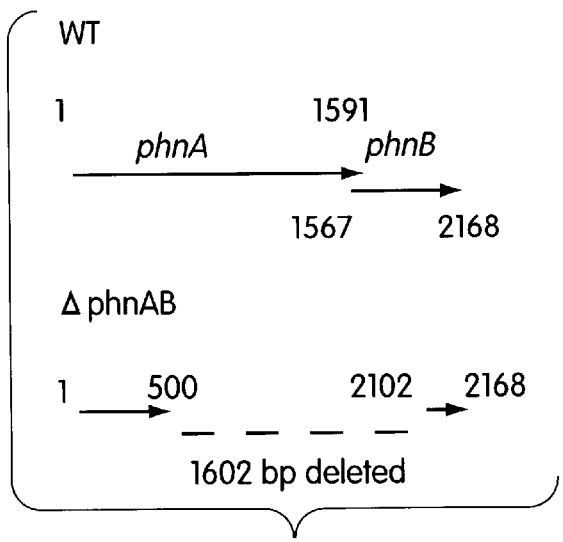

FIG. 35B is a schematic illustration showing the generation of the ΔphnAphnB mutant by an in-frame deletion of 1602 bp within thephnA andphnB genes.

Figure 35C:
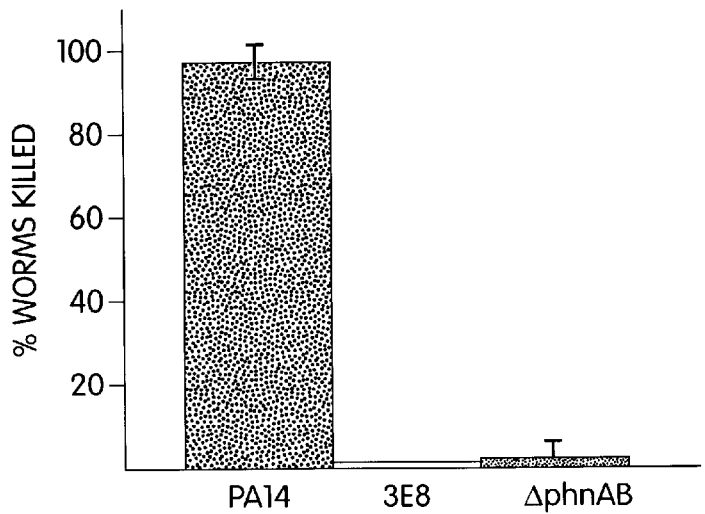

FIG. 35C is a graph showing the effect of the ΔphnAphnB mutant on fast killing in *C. elegans*. Fast-killing assays were conducted using the wild type PA14 strain, the TnphoA mutant 3E8 or the ΔphnAphnB strain. Worm mortality was monitored 3 hours after initial exposure to the bacteria and the defect in fast killing seen with AphnAphnB strain was comparable to that of another phenazine mutant, 3E8.

Virulence Factor Identification and Characterization

As described herein, plants were used as an in vivo pathogenesis model for the identification of virulence factors of the human opportunistic pathogen *Pseudomonas aeruginosa*. Nine out of nine TnphoA mutant derivatives of *P. aeruginosa*. strain UCBPP-PA14 that were identified in a plant leaf assay for less pathogenic mutants also exhibited significantly reduced pathogenicity in a mouse burn assay, suggesting that *P. aeruginosa*. utilized many common strategies to infect both hosts. Seven of these nine mutants contained TnphoA insertions in previously unknown genes. These results demonstrated that an alternative non-vertebrate host of a human bacterial pathogen could be used in an in vivo high throughput screen to identify novel bacterial virulence factors involved in mammalian pathogenesis. These experimental examples are intended to illustrate, not limit, the scope of the claimed invention.

These experiments were carried out using the following techniques.

Strains, Growth Conditions and Plasmids. *P. aeruginosa*. strain UCBPP-PA14 is a human clinical isolate that was used in these experiments for the identification of novel virulence-related genes (Ausubel et al., *Methods of Screening Compounds Useful for Prevention of Infection or Pathogenicity*, U.S. Ser. Nos. 08/411,560, 08/852,927, and 08/962,750, filed on Mar. 25, 1995, May 7, 1997, and Nov. 3, 1997, respectively; Rahme et al., *Science* 268:1899–1902, 1995), and *P. aeruginosa* strains PAK (Ishimoto and Lory, *Proc. Natl. Acad. Sci. USA* 86:1954–1957, 1989) and PAO1 (Holloway et al., *Microbiol. Rev.* 43:73–102, 1979) have been studied extensively in many laboratories. Luria Bertani broth and agar were used for the growth of *P. aeruginosa* and *Escherichia coli* strains at 37° C. Minimal medium (M9) was also used for the growth of *P. aeruginosa*.

Transposon Mutagenesis. Transposon-mediated mutagenesis of UCBPP-PA14 was performed using TnphoA carried on the suicide plasmid pRT731 in *E. coli* strain SM10 λpir (Taylor et al., *J. Bacteriol.* 171:1870–1878, 1989). Donor and recipient cells grown in this medium were plated together on Luria Bertani agar plates and incubated at 37° C. for eight to ten hours and subsequently plated on Luria Bertani plates containing rifampicin (100 μg/ml) (to select against the *E. coli* donor cells) and kanamycin (200 μg/ml) (to select for TnphoA containing *P. aeruginosa* cells). Colonies which grew on the rifampicin and kanamycin media were replicated to Luria Bertani containing ampicillin (300 μg/ml); ampicillin resistant colonies indicated pRT731 integration into the UCBPP-PA14 genome and were discarded.

Alkaline Phosphatase Activity. Two thousand five hundred (2,500) prototrophic UCBPP-PA14 TnphoA mutants were screened on peptone glucose agar plates (Ostroff et al., *J. Bacteriol.* 172:5915–5923, 1990) containing 40 μg/ml 5-bromo-4-chloro-3-indoly phosphate (XP). Peptone medium was selected because it suppressed the production of the endogenous blue-green pigment pyocyanin and the fluorescent yellow pigment pyoverdin, permitting visualization of the blue color that resulted from dephosphorylation of XP by periplasmic alkaline phosphatase generated by PhoA$^+$ mutants.

Growth Conditions and Mutant Isolation Strategy. *P. aeruginosa*strains that were grown to saturation in L-broth at 37° C. were washed in 10 mM MgSO$_4$, resuspended at an optical density of 0.2 (OD$_{600}$=0.2) in 10 mM MgSO$_4$ and diluted 1:100 and 1:1000 (corresponding to a bacterial density of approximately $10^6$ and $10^5$ cfu/ml, respectively). Approximately 10 ml of the diluted cells were inoculated with a Pipetman into stems of approximately twelve-week old lettuce plants (variety Romain or Great lake) grown in MetroMix potting soil in a greenhouse (26° C.). The stems were washed with 0.1% bleach and placed on 15 cm diameter petri dishes containing one Whatman filter (Whatman #1) that was impregnated with 10 mM MgSO$_4$. The midrib of each lettuce leaf was inoculated with three different TnphoA-generated *P. aeruginosa* mutants to be tested and the wild type UCBPP-PA14 strain as a control. The plates were kept in a growth chamber during the course of the experiment at 28–30° C. and 90–100% relative humidity. Symptoms were monitored daily for five days.

In the Arabidopsis leaf infiltration model, *P. aeruginosa* strains grown and washed as above were diluted 1:100 in 10 mM MgSO$_4$ (corresponding to a bacterial density of $10^3$/cm$^2$ leaf disk area) and were injected into leaves of six-week old Arabidopsis plants as described for infiltration of *Pseudomonas syringae* (Ausubel et al., *Methods of Screening Compounds Useful for Prevention of Infection or Pathogenicity*, U.S. Ser. Nos. 08/411,560, 08/852,927, and 08/962,750, filed on Mar. 25, 1995, May 7, 1997, and Nov. 3, 1997, respectively; Rahme et al., *Science* 268:1899–1902, 1995; Dong et al., *Plant Cell* 3:61–72, 1991). Incubation conditions and monitoring of symptoms were the same as in the lettuce experiments. Leaf intercellular fluid containing bacteria was harvested, and bacterial counts were determined as described (Rahme et al., *Science* 268:1899–1902, 1995; Dong et al., *Plant Cell* 3:61–72, 1991). Four different samples were taken using two leaf discs per sample. Control plants inoculated with 10 mM MgSO$_4$ showed no symptom developement.

Mice Mortality Studies. A 5% total surface area burn was fashioned on the outstreached abdominal skin of six-week-old male AKR/J mice (Jackson Laboratories) weighing between 25 and 30 gm as previously described (Ausubel et al., *Methods of Screening Compounds Useful for Prevention of Infection or Pathogenicity*, U.S. Ser. Nos. 08/411,560, 08/852,927, and 08/962,750, filed on Mar. 25, 1995, May 7, 1997, and Nov. 3, 1997, respectively; Rahme et al., *Science* 268:1899–1902, 1995; Stevens, *J Burn Care Rehabil.* 15:232–235, 1994). Immediately following the burn, mice were injected with $5 \times 10^3$ or $5 \times 10^5$ P. aeruginosa cells, and the number of animals that died of sepsis was monitored each day for ten days. Animal study protocols were reviewed and approved by the subcommittee on Animal Studies of the Massachusetts General Hospital. Statistical significance for mortality data was determined using a $\chi^2$ test with Yates'correction or Fisher's exact test. Differences between groups were considered statistically significant at $P \leq 0.05$.

DNA Manipulation, Molecular Cloning, and Sequence Analysis of TnphoA Mutants. *P. aeruginosa* chromosomal DNA was isolated by phenol extraction (Strom and Lory, *J. Bacteriol.* 165:367–372, 1986), and DNA blotting and hybridization studies were performed as described in Ausubel et al. (*Current Protocols in Molecular Biology*, Wiley, New York, 1996).

The oligonucleotides 5'-AATATCGCCCTGAGCAGC-3' (LGR1) (SEQ ID NO. 138) and 5'-AATACACTCACTATGCGCTG-3' (LGR2) (SEQ ID NO:139) corresponded to sequences on opposite strands at the 5'-end of TnphoA. The oligonucleotides 5'-CCATCTCATCAGAGGGTA-3' (LGR3) (SEQ ID NO:140) and 5'-CGTTACCATGTTAGGAGGTC-3' (LGR4)(SEQ ID NO:141) corresponded to sequences on opposite strands at the of the 3'-end of TnphoA. LGR1+LGR2 or LGR3+LGR4 were used to amplify by inverse PCR (IPCR) DNA sequences adjacent to the sites of TnphoA insertion as described (Ochlnan et al., 1993, *A Guide to Methods and Applications*, eds. Innis, M. A., States, D. J., 1990). Amplified DNA fragments ranging in size from 350 to 650 base pairs were cloned into pBlueScript SK+/− by filling in the ends of the IPCR products prior to subcloning into the EcoRV site of pBlueScript SK+/−. To determine the sequence of IPCR-amplified products, double-stranded DNA sequencing was performed using the Sequenase 2.0 kit (U. S. Biochemical, Inc.). Sequences obtained were compared to the non-redundant peptide sequence databases at the National Center for Biotechnology Information (NCBI) using the BLASTX program (Gish and States, *Nat. Genet.* 3:266–272, 1993).

Isolation and DNA Manipulation of the Wild Type Clone Containing the Gene Corresponding to the pho34B12 Mutation from the UCBPP-PA14 Genomic Library. The IPCR product that was generated from UCBPP-PA14 TnphoA mutant pho34B12 mutant was labeled using a random primed DNA labeling kit (Boehringer Mannheim, Indianapolis, Ind.) and used to probe a genomic library of UCBPP-PA14 chromosomal DNA in pJSR1 (Rahme et al., *Science* 268:1899–1902, 1995) for a clone containing the gene corresponding to thepho34B12 mutation. A 3.7 kb EcoRI fragment, identified in cosmid clone pLGR43B12 which corresponded to the pho34B12 mutation, was subcloned into EcoRI site of pRR54 (Roberts et al.,*J. Bacteriol.* 172:6204–6216, 1990) after filling-in the ends of both vector and fragment to construct pLGRE34B12. The same fragment (made blunt ended) was subcloned into the SmaI site of pCVD (Donnenberg and Kaper, *Infect. Immun.* 59:4310–4317, 1991) to construct pLGR34. pLGR34 was used to replace the mutated pho34B12 gene with a wild-type copy as described (Donnenberg and Kaper, *Infect. Immun.* 59:4310–4317, 1991). The 3.7 kb EcoRI fragment was also subcloned into the EcoRI site of pBlueScript SK+/− to construct pBSR34B12 and used for DNA sequence analysis.

A 1,659 base pair sequence corresponding to the pho34B12 insertion that contains two overlapping open reading frames (ORF1 and ORF2) on opposing strands was submitted to GenBank and was assigned Accession No. AF031571. ORF1 is 1,148 bp (nucleotides 361 to 1509) and ORF2 is 1,022 bp (nucleotides 1458 to 436). The overlap of the two ORFs is from nucleotide 436 to 1458. ORF1 contains a second putative translational start site at nucleotide 751 corresponding to a coding region of 758 bp. The oligonucleotide primers 5'-CGCATCGTCGAAACGCTGGCGGCC-3' (SEQ ID NO:142) and 5'-GCCGATGGCGAGATCATGGCGATG-3' (SEQ ID NO:143) were used to amplify a 1100 bp fragment from pBSR34B12 containing ORF1. Because of the two putative initiation sites present in ORF1, the oligonucleotide primers 5'-TGCGCAACGATACGCCGTTGCCGACGATC-3' (SEQ ID NO:144) and 5'-GATTCCACCTTCGCAGCGCAGCCC-3'(Reg3) (SEQ ID NO:145) were also used to amplify a 1659 bp from pBSR34B12 containing ORF1. The oligonucleotide primers 5'-GATTCCACCTTCGCAGCGCAGCCC-3' (SEQ ID NO:146) and 5'-GCCGATGGCGAGATCATGGCGATG-3' (SEQ ID NO:147) were used to amplify a 1302 bp fragment from pBSR34B12 containing ORF2. All primer combinations were designed to contain the putative upstream regulatory elements of each ORF. The PCR products obtained (1100, 1659, and 1302 bp) were cloned into pCR2.1 (Invitrogen Inc.) to construct pLE15, pLE1, and pLE2, respectively. All three PCR products were subcloned into pRR54 to construct pRRLE15, pRRLE1, and pRRLE2, respectively.

Enzymatic Activities of TnphoA Mutants. *P. aeruginosa* strains grown for eighteen hours in LB medium were used for assays of enzymatic activities. Proteolytic and elastolytic activities were determined as described previously (Toder et al., *Mol. Microbiol.* 5:2003–2010, 1991). Quantitation of pyocyanin was determined as described (Essar et al.,*J. Bact.* 172:884–900, 1990). Hemolytic activity was detected following incubation on plates containing Trypticase soy agar (BBL) supplemented with 5% Sheep red blood cells (Ostroff and Vasil, *J. Bacteriol.* 169:4957–4601, 1987).

Generation of a Non-Polar GacA Mutation. A non-polar gacA mutation in UC BPP-PA14 was constructed by cloning a 3.5 kb PstI fragment containing the gacA gene from cosmid pLGR43 (Rahme et al., *Science* 268:1899–1902, 1995) into the unique BamHI restriction site in the suicide vector pEGBR (Akerley et al., *Cell* 80:611–620, 1995) using BamHI linkers. A 950 bp EcoRI-HincII Klenow end-filled fragment containing the kanamycin resistance gene cassette from pUC18K (Menard et al.,*J. Bacteriol.* 175:5899–5906, 1993) was then cloned into the unique BamH1 restriction site (made blunt ended) in gacA, such that transcription was maintained and translation of the downstream portion of gacA was reinitiated at the 3' end of the kanamycin cassette. The resultant construct, SW 7-4, containing the kanamycin gene cassette within the gacA gene and in the orientation of its transcription, was used to marker-exchange by homologous recombination the disrupted gacA gene into the wild-type UCBPP-PA14 genome.

Isolation and Characterization of *P. aeruginosa* Virulence Factors. Using the procedures described above, the *P.* aeruginosa UCBPP-PA14 genome was mutagenized with transposon TnphoA, and 2,500 prototrophic mutants were screened for impaired pathogenicity in the lettuce stem assay. This lettuce assay allowed for the testing of several mutants on a single lettuce stem. Interestingly, we found that lettuce was not only susceptible to infection by UCBPP-PA14 but also was susceptible to the well characterized *P. aeruginosa* strains PAK (Ishimoto and Lory, *Proc. Natl. Acad. Sci USA* 86:1954–1957, 1989) and PAO1 (Holloway et al., *Microbiol. Rev.* 43:73, 1979). Both of these latter strains proliferated in lettuce leaves and elicited disease symptoms similar to those elicited by UCBPP-PA14, characterized by water soaking followed by soft rot four to five days post-infection. In later stages of infection, all three *P. aeruginosa* strains invaded the entire midrib of a lettuce leaf resulting in complete maceration and collapse of the tissue.

As summarized in Table 1, we identified nine TnphoA-generated mutants of UCBPP-PA14 among the 2,500 prototrophs screened that elicited either null, weak, or moderate rotting symptoms on lettuce stems compared to the wild-type strain.

media, the growth rate over time of all nine mutants in Arabidopsis leaves was lower than the wild-type strain. Table 1 lists the maximal levels of growth reached by each mutant at the fourth day post-infection. In the case of all nine mutants, less severe symptom development reflected reduced bacterial counts in leaves. All of the mutants except 33C7 elicited either weak or moderate rot and water soaking symptoms with varying amounts of chlorosis (yellowing) (Table 1). Interestingly, however, as summarized in Table 1, the levels of proliferation of the individual mutants did not directly correlate with the severity of symptoms that they elicited. For example, even though mutant 25A12 (FIG. 21) grew to similar levels as mutants 33A9 (FIGS. 5 and 6A–B), pho34B12 (FIGS. 7A–K, 8, and 9), and 34H4 (FIG. 19), and only ten-fold less than wild-type UCBPP-PA14, mutant 25A12 elicited very weak symptoms. Similarly, mutants 33C7 (FIG. 20), pho15 (FIG. 24B), and 25F1 (FIG. 24A) all reached similar maximal levels of growth (approximately $10^3$-fold less than the growth of the wild type); however, only mutant 33C7 failed to cause any disease symptoms (Table 1). The differences observed in the degree of symp-

TABLE 1

| Strain | Growth in Arabidopsis leaves[a] | Symptoms Elicited in Arabidopsis[b] | % Mouse Mortality[c] | | Gene Identity |
|---|---|---|---|---|---|
| | | | $5 \times 10^3$ | $5 \times 10^5$ | |
| PA14 | $5.5 \times 10^7$ | severe | 53 | 100 | |
| 33C7 | $8.3 \times 10^4$ | none | 0 | 0 | unknown[d] |
| 1D7 | $7.5 \times 10^5$ | weak | 0 | 50 | gacA |
| 25A12 | $1.7 \times 10^6$ | weak | 11 | 87 | unknown |
| 33A9 | $5.1 \times 10^6$ | moderate | 0 | 0 | unknown |
| 25F1 | $1.5 \times 10^4$ | moderate | 0 | 20 | unknown |
| 34H4 | $3.8 \times 10^6$ | moderate | 0 | 33 | unknown |
| pho34B12 | $4.0 \times 10^6$ | moderate | 0 | 56 | unknown |
| pho15 | $3.9 \times 10^4$ | moderate | 0 | 62 | dsbA |
| 16G12 | $2.3 \times 10^5$ | moderate | 20 | 100 | unknown |

[a]Four different samples were taken using two leaf discs/sample. Control plants inoculated with 10 mM MgSO$_4$ showed no symptoms during the course of the experiments. Three independent experiments gave similar results.
[b]Symptoms observed four to five days after infection. None, no symptoms; chlorosis, chlorosis circumscribing the inoculation site; weak, localized water-soaking and chlorosis of tissue circumscribing the inoculation site; moderate, moderate water-soaking and chlorosis with most of the tissue softened around the inoculation site; severe, severe soft-rotting of the entire leaf characterized by a water-soaked reaction zone and chlorosis around the inoculation site at two to three days post-infection.
[c]All animal experiments were conducted at least twice using 8–10 animals/experiment. Independent experiments showed similar percentage mortality rates. Mice were injected with $5 \times 10^3$ or $5 \times 10^5$ cells.
[d]BLASTX analysis yielded no encoded proteins with significant homology.

Severe maceration of the leaf was not observed with any of the mutants. DNA blot analysis showed that each of the nine mutants contained a single TnphoA insertion, using as a probe a 1542 base pair BglI-BamHI fragment containing the kanamycin resistance conferring gene of TnphoA (Taylor et al., *J. Bact.* 171:1870–1878, 1989). Two of the nine UCBPP-PA14 TnphoA mutants, pho34B1, and pho15, expressed alkaline phosphatase activity suggesting that the genes containing these TnphoA insertions encoded membrane-spanning or secreted proteins (Taylor et al., *J. Bact.* 171:1870–1878, 1989; Manoil and Beckwith, *Proc. Natl. Acad. Sci USA* 82:5117, 1985).

The nine TnphoA mutants were further tested by measuring their growth rate over the course of four days in Arabidopsis leaves as a quantitative measure of pathogenicity (Rahme et al., *Science* 268:1899–1902, 1995; Dong et al., *Plant Cell* 3:61–72, 1991). Although none of the mutants showed any significant differences in their growth rates as compared to the wild-type strain in both rich and minimal toms and proliferation levels among the ten mutants suggested that these mutants likely carried insertions in genes that are involved in various stages of the plant infectious process.

The pathogenicity of each of the nine TnphoA-generated mutants that were less pathogenic in the plant leaf assay was measured in a full-thickness skin thermal burn mouse model (Rahme et al., *Science* 268:1899–1902, 1995; Stevens et al., *J. of Burn Care and Rehabil*.15:232–235, 1994). As shown in Table 1, all nine mutants were significantly different from the wild-type with a $P \leq 0.05$ at both doses except for 25A12 and 16G12 (FIG. 24E), which were not significantly different from wild-type at the higher dose of $5 \times 10^5$ cells. In addition to the data shown in Table 1, mutant 33A9 also caused no mortality even at a higher dose of $5 \times 10^6$.

We used DNA blot analysis and DNA sequence analysis to determine whether TnphoA in the nine less pathogenic mutants had inserted in known genes. DNA blot analysis revealed that mutant 1D 7 contained a TnphoA insertion in the gacA gene (Laville et al., *Proc. Natl. Acad. Sci. USA* 89:1562–1566, 1992; Gaffney et al., *Mol. Plant-Microbe Interact.* 7:455–463, 1994) which we had shown previously to be an important pathogenicity factor for *P. aeruginosa* in both plants and animals (Ausubel et al., *Methods of Screening Compounds Useful for Prevention of Infection or Pathogenicity*, U.S. Ser. Nos. 08/411,560, 08/852,927, and 08/962,750, filed on Mar. 25, 1995, May 7, 1997, and Nov. 3, 1997, respectively; Rahme et al., *Science* 268:1899–1902, 1995). For the other eight mutants we used the inverse polymerase chain reaction (IPCR) to generate amplified products corresponding to DNA sequences adjacent to the sites of the TnphoA insertions (Ochman et al., *A Guide to Methods and Applications*, eds., Innis, M. A., States, D. J., . 1990). The IPCR products were cloned and then subjected to DNA sequence analysis. Mutant pho1contained TnphoA inserted into a *P. aeruginosa* gene (from strain PAO1) previously deposited in GenBank (Accession # U84726) that shows a high degree similarity to the *Azotobacter vinelandii* dsbA gene, which encodes a periplasmic disulfide bond forming enzyme (Bardwell et al., *Cell* 67:581–589, 1991). Homologues of dsbA in the bacterial phytopathogen *Erwinia chrysanthemi* and in the human pathogens *Shigella flexneri* and *Vibrio cholera* are required for pathogenesis (Shevchik et al., *Mol. Microbiol.* 16:745–753, 1995; Peek and Taylor, *Proc. Natl. Acad. Sci. USA* 89:6210–6214, 1992; Watarai et al., *Proc. Natl. Acad. Sci. USA* 92:4927–4931, 1995). Computer analysis using the program BLASTX showed that when the DNA sequences corresponding to the remaining seven TnphoA insertions were translated in all possible reading frames, no significant similarities to any known genes were found (Table 1).

We performed a variety of biochemical tests to categorize the nine less pathogenic UCBPP-PA14 mutants on the basis of whether they carried defects in previously described primary virulence factors and/or metabolic pathways. All mutants were assayed for protease, elastase, and phospholipase activities and for their ability to secrete the secondary metabolite pyocyanin (Toder et al., *Mol. Microbiol.* 5:2003–2010, 1991; Essar et al., *J. Bact.* 172:884–900, 1990; Ostroff and Vasil, *J. Bacteriol.* 169:45974601, 1987). Pyocyanin is a redox-active phenazine compound excreted by most clinical strains of *P. aeruginosa* that kills mammalian and bacterial cells through the generation of reactive oxygen intermediates and which has been implicated as a *P. aeruginosa* virulence factor (Hassett et al. *Infect. Immun.* 60:328–336, 1992; Kanthakumar et al., *Infect. Immun.* 61:2848–2853, 1993; Miller et al. *Infect. Immun.* 64:182, 1996). Mutants 33C7, 33A9, 34H4, 25F1, and 16G12 showed no defects in any of the biochemical assays used. Mutant pho34B12 showed decreased hemolytic activity on blood agar plates, reduced elastase activity (~50%), and no detectable pyocyanin production. Mutant pho15 showed only traces of elastase activity and a decrease in proteolytic activity (60–70%) compared to the wild-type. Mutant 25A12 showed a 50% decreased elastolytic activity. Finally, mutant 1D7 which contained an insertion in gacA, showed reduced levels of pyocyanin (50%) as compared to the wild-type. In addition to mutant 1D7 a second independent gacA:TnphoA mutant was identified from our plant screen, mutant 33D11. This latter mutant also exhibited a similar reduction in pyocyanin production and reduced virulence in both plants and mice.

On the basis of the DNA sequence analysis and biochemical testing of the mutants, the genes targeted by the TnphoA insertions in mutants ID7 and pho34B12 were chosen for further analysis. As discussed above, ID 7 contained an insertion in gacA which we had shown previously to encode a virulence factor in *P. aeruginosa* (Rahme et al, *Science* 268:1899–1902, 1995). Recently a gacA-like gene has also been shown to be an important virulence factor for *Salmonella typhimurium* (Johnston et al., *Mol. Microbiol.* 22:715, 1996). However, the two gacA:TnphoA insertions (1D7 and 33D11), the gacA insertion mutant that we constructed previously (Ausubel et al., *Methods of Screening Compounds Useful for Prevention of Infection or Pathogenicity*, U.S. Ser. Nos. 08/411,560, 08/852,927, and 08/962,750, filed on Mar. 25, 1995, May 7, 1997, and Nov. 3, 1997, respectively; Rahme et al., *Science* 268:1899–1902, 1995), and an independently constructed *P. aeruginosa* gacA mutation that affects the production of several known virulence factors (Hassett et al., *Infect. Immun.* 60:328–336, 1992) all exert a polar effect on at least one gene, a homologue of the *E. coli* uvrC gene immediately downstream of gacA (Rahme et al., *Science* 268:1899–1902, 1995; Laville et al., *Proc. Natl. Acad. Sci. USA* 89:1562–1566, 1992; Reimmann et al., *Mol. Microbiol.* 24:309–319, 1997). To provide definitive evidence that the loss of pathogenicity phenotypes of the gacA mutants described herein was due to the disruption of the gacA open reading frame per se rather than due to a polar effect on a gene downstream of gacA, we constructed a non-polar gacA mutation in UCBPP-PA14 using a DNA cassette encoding a gene that confers kanamycin resistance. Importantly, the non-polar gacA mutant exhibited the same diminished level of pathogenicity in the mouse assay (50% mortality) and in the Arabidopsis assay (growth to $3 \times 10^5$ cfu/cm$^2$ after four days) as the gacA:TnphoA mutant (1D7), but did not exhibit the extreme UV sensitivity of the polar gacA mutants. Like 1D7, the non-polar gacA mutant also excreted lower levels of pyocyanin (50%) compared to the wild-type.

Mutant pho34B12 was chosen for further analysis for the following reasons. First, the insertion in pho34B12 was situated directly downstream of the *P. aeruginosa* pyocyanin biosynthetic genes phnA and phnB (Essar et al. *J. Bact.* 172:884–900, 1990), in a previously uncharacterized region of the *P. aeruginosa* genome. Second, the pho34B12 insertion caused a pleiotropic phenotype that included reduced elastase and hemolytic activities, suggesting that the gene in which the pho34B12 TnphoA insertion was situated might encode a regulator of diverse pathogenicity factors.

To rule out the possibility that a secondary mutation in pho34B12 was responsible for the loss of pathogenicity phenotype rather than the TnphoA insertion, we replaced the pho34B12::TnphoA mutation by homologous recombination with the corresponding wild type gene. This resulted in restoration of the pathogenicity defect in both plants and animals as well as restoration of hemolytic and elastolytic activity and pyocyanin production to wild-type levels (Table 2, below).

TABLE 2[a]

| Strain | Growth in Arabidopsis Leaves | Symptoms Elicited in Arabidopsis | % mouse mortality $5 \times 10^5$ | % pyocyanin |
|---|---|---|---|---|
| PA14 | $5.5 \times 10^7$ | severe | 100 | 100 |
| pho34B12 | $4.0 \times 10^6$ | moderate | 56 | $\leq 1$ |
| pho34B12 reconstructed to wild-type | $3.9 \times 10^7$ | severe | 100 | 120 |
| pho34B12 + pLGRE34B12 | $6.1 \times 10^5$ | moderate | 0 | 600 |
| pho34B12 + pRRLE2 | $7.0 \times 10^5$ | moderate | 13 | 40 |
| pho34B12 + pRRLE1 | $5.0 \times 10^5$ | moderate | 13 | 1,400 |
| pho34B12 + pRRLE15 | $1.0 \times 10^5$ | moderate | 22 | 1,360 |

[a]See Table 1 for an explanation of table entries.

These results in Table 2 show that the TnphoA insertion inpho34B12 was the cause of the pleiotropic phenotype of this strain, including the loss of pathogenicity phenotype. The fact that no putative ORFs were present in the next 500 bp downstream of the stop codon following the pho34B12:TnphoA insertion (see below) made it unlikely that TnphoA exerted a polar effect on a downstream gene which was responsible for the phenotype of mutant pho34B12. Genetic complementation analysis of pho34B12 with a plasmid (pLGRE34B12) containing a 3.7 kb insert which included pho34B12 and part of the phnAB region resulted in restoration of the elastase and hemolytic activities to wild-type levels and more than a ten-fold overproduction of pyocyanin (Table 2). However, the impaired pathogenicity phenotype of pho34B12 in both Arabidopsis and mice was not complemented by pLGRE34B12 (Table 2), most likely due to the presence of multiple copies of the wild-type gene corresponding to pho34B12.

Further DNA sequence analysis showed that the region containing the pho34B12 mutation encoded two almost completely overlapping open reading frames (ORFs) (ORF1 and ORF2) that were transcribed in opposite directions. Moreover, ORF1 had two potential methionine start codons (designated OFR1-S and ORF1-L). The predicted proteins encoded by ORF1-S and ORF1-L, which were transcribed in the same direction as the phnA, phnB, and phoA genes, contained a consensus motif that corresponded to a lipid attachment site found in a variety of prokaryotic membrane lipoproteins (Hayashi and Wu, *J. Bioenerg. Biomembr.* 22:451–471, 1990). These membrane lipoproteins are synthesized with a precursor signal peptide, providing an explanation for the Pho+ phenotype of the pho34B12 insertion (Hayashi and Wu, *J. Bioenerg. Biomembr.* 22:451–471, 1990). The predicted protein encoded by ORF2 contained an N-terminal 'helix-turn-helix' DNA-binding motif similar to the 'helix-turn-helix' motif found in the LysR family of transcriptional regulators (Henikoff et al, *Proc. Natl. Acad. Sci. USA* 85:6602–6606, 1988; Viale et al., *J. Bacteriol*, 173:5224–5229, 1991). This class of proteins includes regulators involved in both mammalian and plant pathogenesis (Finlay and Falkow, *Microbiol. and Mol. Biol. Rev.* 61:136–169, 1997). The existence of two functional almost completely overlapping ORFs is unusual in bacterial genomes.

To determine which of the ORFs encoded in the pho34B12 region were functional, additional complementation analysis was carried out using plasmids that contained PCR products corresponding to ORF1-S, ORF1-L, and ORF2 (FIGS. 7F, 7H, and 7J). The production of both pyocyanin and elastolytic activity was restored to 20–40% of wild type levels by the plasmid synthesizing the protein encoded by ORF2 (pRRLE2). Similarly, the hemolytic ability of this complemented strain was partially restored. Complementation of pho34B12 with plasmids pRRLE1 and PRRLE15, corresponding to ORF1-S and ORF1-L, respectively, also restored the hemolytic, pyocyanin, and elastolytic activities. Interestingly, however, the presence of plasmids pRRLE1 and pRRLE15 resulted in a 10-fold higher production of pyocyanin and a 2-fold higher level of elastase activity. Neither pRRLEI, pRRLE15, nor pRRLE2 complemented the loss of pathogenicity phenotypes of mutant pho34B12 in either plants or animals (Table 2). Further characterization of this region including site directed mutagenesis will further elucidate which of the three ORFs is (are) required for pathogenicity in plants and animals.

The data presented above demonstrated that previously unknown *P. aeruginosa* virulence factors (genes) that play a significant role in mammalian pathogenesis can be readily identified by screening random *P. aeruginosa* mutants for ones that display attenuated pathogenic symptoms in plants. This is consistent with our previous study in which we demonstrated that at least three *P. aeruginosa* genes encode virulence factors involved in both plant and animal pathogenesis (Ausubel et al., *Methods of Screening Compounds Useful for Prevention of Infection or Pathogenicity*, U.S. Ser. Nos. 08/411,560, 08/852,927, and 08/962,750, filed on Mar. 25, 1995, May 7, 1997, and Nov. 3, 1997, respectively; Rahme et al., *Science* 268:1899–1902, 1995). On the other hand, we did not expect to find that nine out of nine mutants that we isolated that were less virulent in plants would also be less virulent in mice. The simplest interpretation of this result is that *P. aeruginosa* pathogenesis in plants and animals utilizes a substantially overlapping set of genes which may be considered to be basic virulence genes. Another possible interpretation is that some of the identified genes may encode regulatory proteins (i.e., pho34B12), that control different effector molecules, a subset of which may be specific for either plants or animals. We also did not expect that the majority of mutants that would be identified in this study (7 out of 9) would correspond to previously unknown genes. Using the Poisson distribution, a genome size for *P. aeruginosa* of 5.9 Mb and an average gene size of 1.1 kb, we calculated that the 2,500 mutants tested represents 25% of the total number that needs to be tested to give approximately 95% probability of testing each gene in the assay. Therefore, since our screen for *P. aeruginosa* virulence mutants is not nearly saturated, it is likely that many additional *P. aeruginosa* genes with important roles in pathogenicity await discovery.

Importantly, at least two of the previously known virulence factors (genes) identified in our model as being important in plant pathogenesis, are not only important virulence factors for *P. aeruginosa* in a mouse burn model, but have also been described as important virulence factors in other gram-negative pathogens. These latter pathogenicity factors (genes) include dsbA, and gacA (Shevchik et al. *Mol. Microbiol.* 16:745–753, 1995; Peek and Taylor, *Proc. Natl. Acad. Sci. USA* 89:6210–6214, 1992; Watarai et al., *Proc. Natl. Acad. Sci. USA* 92:4927–4931, 1995; Johnston, et al., *Mol. Microbiol.* 22:715, 1996). This makes it likely that many of the previously unknown factors identified in *P. aeruginosa* will be generally relevant for gram-negative pathogenesis.

Another important conclusion from this study is that the high throughput in vivo screening method that we have developed can lead to the identification of pathogenicity factors that do not correlate with obvious biochemical defects. Mutants 33C7, 33A9, 34H4, 25F1, and 16G12 exhibited no detectable defects in several known *P. aeruginosa* pathogenicity factors and, importantly, mutants 33C7 and 33A9 were among the most debilitated in the mouse model. Moreover, even though mutants pho34B12 and 25A12 did exhibit diminished production of known virulence factors, the genes corresponding to these mutants have not been identified previously, most likely because the biochemical defects in these mutants cannot be readily identified efficiently in a simple high throughput screen. This attests to the sensitivity of our screen for loss of pathogenicity phenotypes.

In the last few years, other high throughput screens for identifying bacterial pathogenicity factors have been described. The IVET (in vivo expression technology) identifies promoters that are specifically activated during pathogenesis (Wang et al., *Proc. Natl. Acad. Sci. USA.* 93:10434–10439, 1996; Mahan et al., *Science* 259:686–688, 1993), STM (signature-tagged transposon method) identifies genes that are required for survival in a host (Hensel, *Science* 268:400–403, 1995) and DFI (differential fluorescence induction) utilizes green fluorescent protein and fluorescence activated cell sorting to identify genes that are activated under specific conditions or in specific host cell types (Valdivia and Falkow, *Mol. Microbiol.* 22:367–378, 1996). These approaches are complimentary with the one that we have described in this application and each approach has advantages and disadvantages. One advantage of our screening procedure in a non-vertebrate host is that it directly measures pathogenicity whereas the IVET and DFI methods measure pathogenicity-associated gene expression. Unlike the STM procedure, which identifies genes whose function cannot be complemented in trans by the mixed population of bacterial mutants used for the inoculum, the present screen in a non-vertebrate involves testing each mutant clone separately.

Other Virulence Targets

Figure 1B:
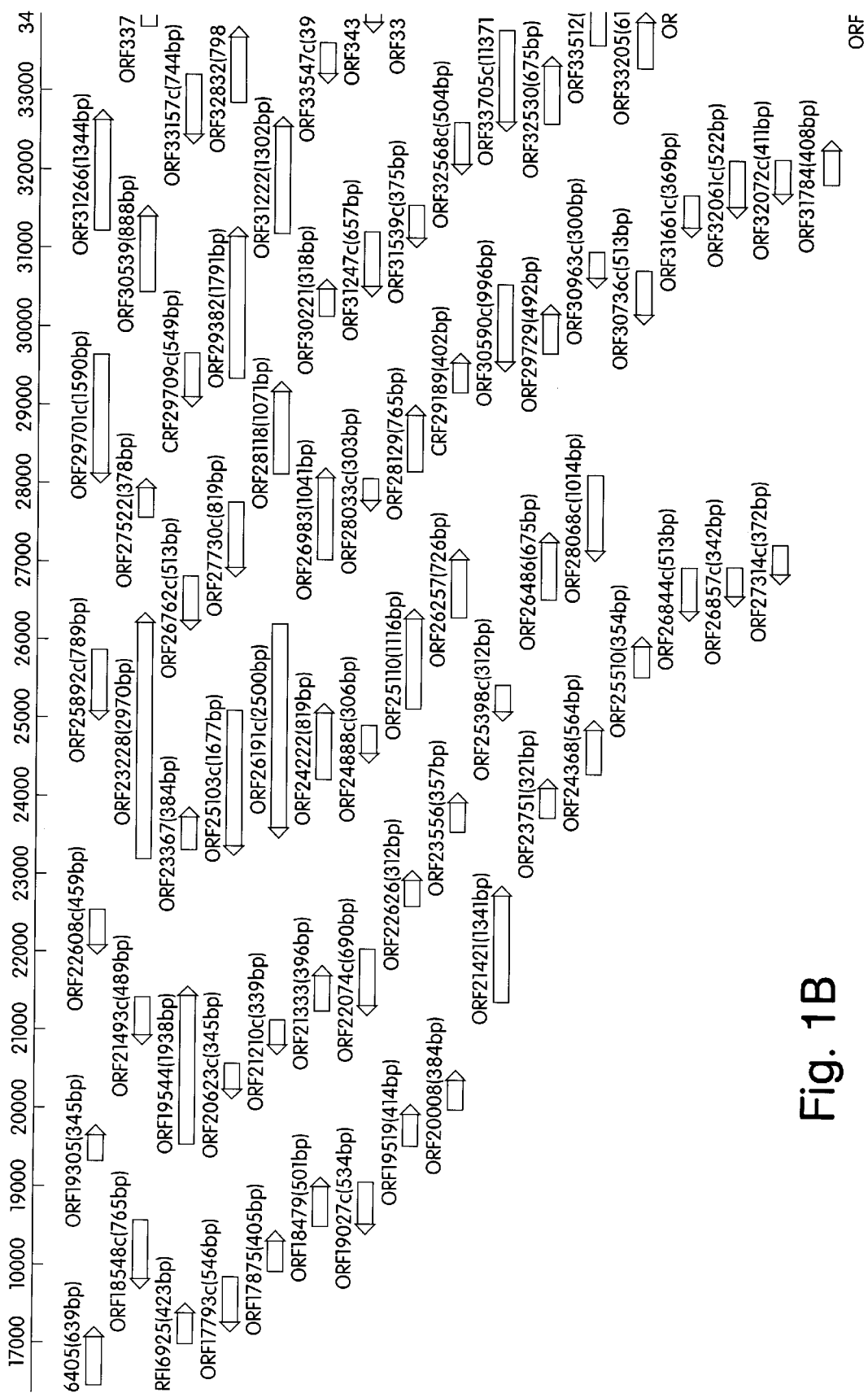
Figure 1C:
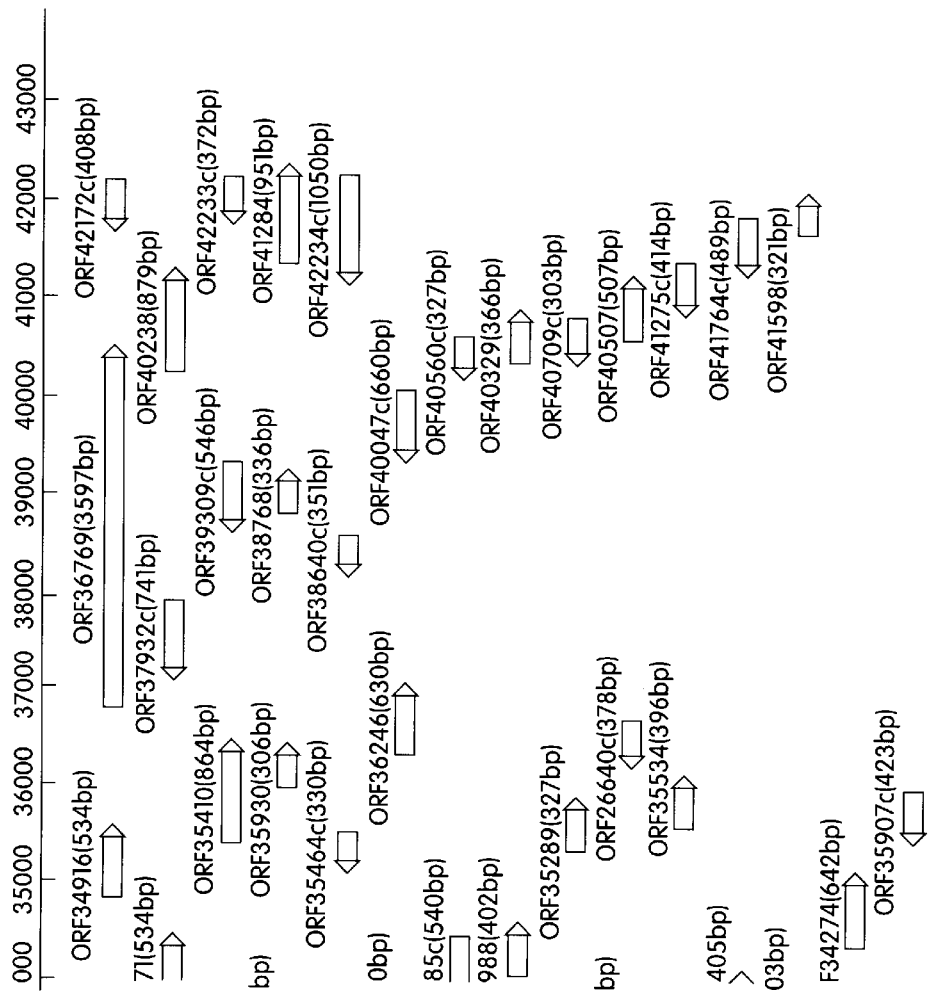

The 33A9 nucleic acid sequence (FIGS. 5 and 6A–U) was also identified in a cosmid clone designated BI48 (FIG. 1A–C). This cosmid was sequenced in its entirety and its nucleic acid sequence is shown in FIGS. 2A–K. Using standard database analysis, the nucleotide sequences and deduced amino acid sequences of several additional open reading frames were identified (FIGS. 3-1 to 3-39 and 4-1 to 4-22). A summary of this analysis is presented in Table 3. Like the sequences described above, any one of the sequences found in FIGS. 3-1 to 3-39 and 4-1 to 4-22 can be used to screen for compounds (e.g., using the methods described herein) that reduce the virulence of a pathogen.

The sequence obtained from the pBI48 cosmid of strain PA14 revealed that 33A9 was located approximately 5 kb upstream of a pili gene cluster (FIGS. 1A–C, Table 3). This cluster contains the pilS/pilR genes, known to be involved in the regulation of pili formation. Moreover, the analysis of the sequence upstream of 33A9 did not show any homology with previously identified sequences suggesting the possibility that the entire region surrounding 33A9 could define a pathogenicity island. FIGS. 3-17 (orf 19544), FIG. 4-10 (orf 19544), 5, 6A, and 6U, show the 33A9 nucleotide sequence, as well as the identified ORFs.

In addition, analysis of the sequence obtained from the pBI48 cosmid clone indicated the presence of a sequence located approximately 2 kb downstream of 33A9, which showed strong homology with tRNA sequences (ORF22626, FIG. 1). Because the analysis of the region located upstream of the tRNA sequence did not show any homology with sequences present in the database, and because tRNA sequences represent "hot spots" for DNA insertions, we hypothesized that the tRNA sequence represented the right boundary for the insertion of a pathogenicity island present in PA14. As seen in FIG. 1 the size of the region that could represent the piece of foreign DNA that was inserted is approximately 25 kb. The identification of the boundary that is located upstream of the presumptive pathogenicity island will assist to establish the exact size of the inserted piece of DNA. Moreover, the analysis of the 33A9 region also indicated the presence of more than one sequence with homology at the protein level to integrases and transposases (ORF21421, ORF8109 respectively). Finally, our data showed that the 33A9 locus was present in several highly pathogenic *P. aeruginosa* clinical isolates, and absent in PAO1, a less pathogenic strain of *P. aeruginosa*.

The analysis of the sequencing data obtained from the pBI48 cosmid also indicated the presence of two sequences flanking the 33A9 gene which contained recognition motifs involved in cell attachment. Sequence analysis of ORF11738 (2436 bp) and ORF23228 (2565 bp), upstream and downstream of 33A9 respectively (FIG. 1), indicated the presence of RGD motifs in these two open reading frames. RGD tripeptide sequences are a characteristic eukaryotic recognition motif that binds to host cell surface integrins and have been found to be involved in bacterial adherence. By mimicking host molecules, bacterial adhesins that contain these RGD motifs can effect responses in the host that are required to promote cell-cell adhesion.

The expression of these two RGD-containing ORFs was evaluated in both 33A9 and the wild type strain PA14. Transcript levels were determined by hybridization with a radiolabeled DNA probe that corresponded to an internal region of ORF11738 and ORF23228. The data obtained for the two ORFs in the mutant 33A9 showed reduced transcript levels compared to the wild type PA14, indicating that the genes encoded by ORF11738 and ORF23228 are both regulated by 33A9. These data indicated that 33A9 plays a role as a multigene regulator responsible for the regulation of the expression of genes involved in bacterial attachment to host cell surfaces.

TABLE 3

| ORF | Start | Stop | Length | Blast n | Blastp | Motif | Terminator | Shine-Delgarno |
|---|---|---|---|---|---|---|---|---|
| 244c | 244 | 35 | 210 | | | | | |
| 602c | 602 | 42 | 561 | | | | | 730 |
| 214 | 214 | 792 | 579 | | | | | |
| 594 | 594 | 3734 | 3141 | | Conjugal transfer prtn | ATP/GTP BINDING | 730 | |
| 1205C | 1205 | 987 | 219 | | | | | |
| 1640C | 1640 | 1206 | 435 | | | | | |
| 1615C | 1615 | 1439 | 177 | | rev transcriptase | | | |
| 2929c | 2929 | 2288 | 642 | | adhesin precursor | | | |
| 3994c | 3994 | 3818 | 177 | | outer memb. protein | | | |
| 4506C | 4506 | 3862 | 645 | | | lipoprotein | 4442 | |
| 4901c | 4901 | 4668 | 234 | | atp-dep. ma helicase | | 4726 | |
| 10475 | 10475 | 10828 | 354 | | unk. mycobacterium | | | |
| 11738 | 11738 | 14173 | 2436 | | mycobact.unk. | ATP/GTP BINDING | | |
| 14155 | 14155 | 16101 | 1947 | | DNA helicase | ATP/GTP BINDING | 15915 | |
| 21421 | 21421 | 22761 | 1341 | several P.a.genes | integrase | | 22982 | 21464 |
| 22505 | 22505 | 22657 | 153 | t-RNAs,oprL, | | prenylation | | |
| 23228 | 23228 | 26197 | 2970 | atp dep. protease | | zinc protease | | |
| 26191c | 26191 | 23612 | 2580 | clp proteases, | ClpB | ATP/GTP BINDING | 23603 | |
| 26844c | 26844 | 26332 | 513 | | ClpB | | | |
| 26486 | 26486 | 27160 | 675 | | Memb.glycoprotein | | | |
| 26857c | 26857 | 26516 | 342 | | viral nucl.antigen | | | |
| 28068c | 28068 | 27055 | 1014 | | PilS | yabO (hypothetical) | | |
| 28118 | 28118 | 29188 | 1071 | | PilS | lipoprotein | | |
| 29382 | 29382 | 31172 | 1791 | | PilS | 31186 | | |
| 31247c | 31247 | 30591 | 657 | | | FABprotein | | |
| 31222 | 31222 | 32523 | 1302 | | AlgB, PilR | sigma54interaction domain | 31518 | |
| 32568c | 32568 | 32065 | 504 | | | tonB (Fe receptor) | 32567 | |
| 33705c | 33705 | 32569 | 1137 | | PilR, D-AA | | 32567; 32609 | 33678 |
| | | | | | | dehydrogenase | | |
| 34274 | 34274 | 34915 | 642 | | pilin | Nterm mrthyl (pilin) | | |
| 34916 | 34916 | 35449 | 534 | | prepilin leader | | | |
| 36246 | 36246 | 36875 | 630 | Pil genes} | pilx, pilyl | | | |
| 41284 | 41284 | 42234 | 951 | | | sugar transport | 41175; 41170 | |
| 42236c | 42236 | 41185 | 1052 | | LYTB | | | |

In addition, using the plant and nematode screening assays (slow- or fast-killing assays) described in Ausubel et al. (*Methods of Screening Compounds Useful for Prevention of Infection or Pathogenicity*, U.S. Ser. Nos. 08/411,560, 08/852,927, and 08/962,750, filed on Mar. 25, 1995, May 7, 1997, and Nov. 3, 1997, respectively), several other mutant *Pseudomonas aeruginosa* strains were identified as having decreased virulence. The slow- and fast-killing assays utilized for these studies are described below.

Slow-killing assay. For the slow-killing assay, 10 µl of an overnight bacterial culture was spread on an NG plate (modified from NGM agar described in Sulston and Hodgkin (In: *The Nematode Caenorhabditis elegans*, W. B. Wood, ed., Cold Spring Harbor, N.Y.: Cold Spring Harbor Laboratory, 188, pp. 587–606): (0.35% instead of 0.25% peptone was used) and incubated at 37° C. for 24 hours. After 8–24 hours at room temperature (23–25° C.) each plate (3.5 cm diameter) was seeded with 40–50 hermaphrodite L4 *C. elegans* strain Bristol; for statistical purposes, 3–4 replicates per trial were carried out. Plates were incubated at 25° C., and the number of dead worms were scored every 4–6 hours. A worm was considered dead when it no longer moved when touched with an eyelash and failed to display any pharyneal pumping action. For each batch of mutants assayed., PA14 and *E. coli* OP50 were used as positive and negative controls. Any worms that died as a result of being immobilized to the wall of the plate were excluded from the analysis. In order to determine $LT_{50}$, data were plotted on a graph (percentage of worms killed vs. time after exposure to test strains (hour)). A curve of the form: percentage killed= $A+(1-A)/(1+\exp(B-G \times \log(\text{hours after exposure})))$ was fitted to the data using the SYSTAT 5.2.1 computer program, where A represented the fraction of worms dying in a OP50 control experiment, and B and G are parameters which were varied to fit the curve. Once B and G have been determined., $LT_{50}$ is calculated by the formula $$LT_{50} = \exp(B/G) \times (1-2 \times A)^{(1/G)}.$$

In developing the screen, we took advantage of two observations. First, the longer it took for the worms to be killed., the more progeny were produced. Second, early larval stages are apparently more resistant to killing by *P. aeruginosa*. This provided us with a convenient and very sensitive assay for the identification of TnphoA mutants that are only slightly impaired in their pathogenic potential. These attenuated mutants would be less efficient at killing worms, and the production of progeny by survivors effectively "amplifies" even a weak defect into a readily observable phenotype. Thus, on plates containing attenuated PA14::TnphoA mutants, from the initial seeded hermaphrodites, hundreds of worms were obtained. On plates seeded with a nonpathogenic mutant, thousands of worms were seen by day five and the bacterial lawn was completely consumed., whereas none or very few live worms were found on the plates seeded with the wild-type strain. Putative nonpathogenic or attenuated mutants identified in the preliminary screen were retested., and subjected to a virulence assay to determine the *C. elegans*-killing kinetics.

Fast-killing Assay. The fast-killing assay, like the slow-killing assay, is useful for identifying disease-causing microbial virulence factors. In addition, the assay is useful for identifying therapeutics that are capable of either inhibiting pathogenicity or increasing an organism's resistance capabilities to a pathogen. In preferred embodiments, the fast-killing assay is carried out using a nematode strain having increased permeability to a compound, e.g., a toxin such as colchicine. Examples of nematodes having such increased permeability include, without limitation, animals having a mutation in a P-glycoprotein, e.g., PGP-1, PGP-3, or MRP-1. Such mutant nematodes are useful in the fast-killing assay because of their increased sensitivity to toxins that is due to increased membrane permeability. This characteristic results in an assay with an increased differential between full susceptibility and full resistance to toxic compounds. The fast-killing assay may also be carried out by increasing the osmolarity of the culture medium as described below.

The fast-killing assay conditions utilized herein are as follows, 5 μl of a PA14 culture grown overnight in Kings B was spread on plates (3.5 cm diameter) containing peptone-glucose medium (PG), (1% Bacto-Peptone, 1% NaCl, 1% glucose, 1.7% Bacto-Agar). Since the efficacy of fast-killing was found to depend on osmolarity, PG medium was modified by the addition of 0.15 M sorbitol. After spreading the bacterial culture, plates were incubated at 37° C. for 24 hours and then placed at room temperature for 8–12 hours. Fifteen to twenty worms were placed on the assay plate, which was then incubated at 25° C. Each independent assay consisted of 3–4 replicates. Worm mortality was scored over time, and a worm was considered dead when it failed to respond to touch as is described above. The $E.$ $coli$ strain DH5α was used as a control for the fast-killing assays.

An analysis of these strains, together with those identified above, indicated that they fell into several different classes including the following: some mutants were less pathogenic on both plants and nematodes, whereas others were reduced in either plants or nematodes, but not both. Bacterial mutants less pathogenic in plants were defined as those which, at four days post-infiltration (DPI), had a mean maximum titer (from 5 leaf samples) of two standard deviations lower relative to wild-type within the same set of experiments. The wild-type control was necessary because the maximal level reached by wild-type at four DPI could vary as much as an order of magnitude between experiments due to the effects of minor variations in growth conditions on the plant defense responses. Similarly, a mutant was characterized as reduced in pathogenicity in worms if the mean time required to kill 50% of the worms feeding on it ($LT_{50}$ from 3 replicates) was two standard deviations less than $LT_{50}$ of wild-type PA14 in the same experiment.

In general, those mutant strains having reduced pathogenicity in plants included 16G12, 25A12, 33A9, and 33C7; those having reduced pathogenicity in nematodes included the 35A9, 44B1, 1G2, 8C12, and 2A8, and those having reduced pathogenicity in plants and nematodes included 25F1, 41A5, 50E12, pho15, 12A1, pho23, 34B12, 34H4. 3E8, 23A2, and 36A4. Tables 4 and 5 (below) summarize the pathogenicity phenotypes of these mutant strains. Sequence analysis was carried out for each of these strains having decreased virulence due to insertional mutagenesis. The DNA sequence analyses, summarized in Tables 4 and 5, showed that both novel and known genes were identified in our screening assays. Sequences from 50E12 and 41C1 each show strong similarity to previously described open reading frames (ORFs) of unknown function in $E.$ $coli$. Mutant 35A9 identified a mtrR homologue of $N.$ $gonorrhoeae$ (SwissProt P39897). Mutant 25F1 identified an operon encoding 3 proteins having identity to orfT of $C.$ $tepidium$, MPK, and $DjlA_{Ec}$. Sequences from 48D9, 35H7, and 12A1 corresponded to the lemA, gacA, and lasR genes, respectively. The sequences disrupted in mutants 41A5 and 44B1 do not have significant similarity to any sequence deposited in GenBank. (The 44B1-sequence tag is only 148 bp because and there were no sequences corresponding to the 44B1 insertion in the PAO1 database were identified). Accordingly, these sequences identify additional virulence factors. The nucleotide and amino acid sequences obtained from these experiments are shown in FIGS. 10, 11, 12A–C, 13, 14A–D, 15, 16, 16A, 16B, 17, 18A, 18B, 18C, 18D, and 18E and FIGS. 22, 23, 24A–L, 25A, 25B, 26, 27, and 28.

We also carried out a battery of standard biochemical tests on TnphoA mutants 41A5, 50E12, 41 C, 35A9, 48D9, 12A, 44BI, and 35H7 to assess if any contained lesions in known $P.$ $aeruginosa$ virulence factors important for mammalian pathogenicity. These tests included: a standard plate assay for sensitivity to $H_2O_2$, as well as standard quantitative analysis of extracellular protease, elastase, phospholipase C, and pyocyanin. Except for the following, the majority of the PA14 TnphoA mutants were indistinguishable biochemically from the parent PA14 strain. Mutant 12A exhibited decreased elastolytic and proteolytic activities but overproduced pyocyanin. Mutant 50E12 produced 3-fold higher levels of pyocyanin than PA14. Mutant 41A5 had only about 70% of wild-type levels of proteolytic activity.

A detailed description of the DNA sequence analysis and biochemical analysis of each of these mutants identified using the slow-killing assay (described above) is now presented in the following sections.

Mutant 12A1. The Tn phoA insertion in 12A1 was inserted into codon 154 of the previously described lasR gene of $P.$ $aeruginosa$ PA1. The phenotype of 12A1, like other known lasR mutants, is pleiotropic, and includes decreased elastase and protease production. In addition 12A1 produced 2–3 times more pyocyanin than the parent PA14 strain at stationary phase. Furthermore, a lasR mutant expressing GFP (PA14lasR:GFP19-1) failed to establish itself in the worm gut as very little fluorescence was detected in $C.$ $elegans$ intestines after 48 hours of feeding.

FIG. 34A shows that the defective nematode slow-killing phenotype of 12A1 was completely restored when the $P.$ $aeruginosa$ PAO1 lasR gene was expressed in trans under the control of the constitutive lacZ promoter in strain 12A1(pKDT17). The production of elastase was also found to be restored to wild-type levels in 12A1(pKDT17), but not the overproduction of pyocyanin. Because the pyocyanin-overproduction phenotype was not expected., we constructed a new lasR mutant, lasR::Gm, by marker exchanging a lasR gene interrupted by a gentamicin cassette into the PA14 genome. The lasR::Gm mutant was as nonpathogenic as 12A1 (FIG. 34A), but produced normal levels of pyocyanin, suggesting that 12A1 may harbor a second mutation that resulted in the upregulation of pyocyanin production. The result also indicated that the upregulation of pyocyanin production during the stationary phase is not related to the attenuated pathogenicity phenotype.

Mutant pho15. Disruption of the dsbA gene in pho15 was found to be responsible for the nonpathogenic phenotypes. FIG. 24G shows the nucleotide sequence (SEQ ID NO:166) and predicted amino acid sequence (SEQ ID NO:167) of PA14phol5. The pathogenicity defective phenotype of phol15 in $C.$ $elegans$ was also found to be fully restored by constitutive expression of the $E.$ $coli$ $dsbA^{Ec}$ gene or the PA14 $dsbA_{Pa}$ gene in trans in the pho15 background (FIG. 34B). For these experiments, the $E.$ $coli$ $dsbA_{Ec}$ gene was cloned into pUCP18 as follows. The PCR-amplified $E.$ $coli$ dsbA was cloned into the KpnI and XbaI sites of pBAD18 to form pCH3. This placed the E. coli dsbA under the E. coli arabinose promoter. A 700 bp KpnI/SphI fragment containing the E. coli dsbA was cloned into the KpnI/SphI sites of pUCP18, to make pEcdsbA, placing the E. coli dsbA under the constitutive E. coli lacZ promoter. pEcdsbA was subsequently used to transform PA14 and pho15 to construct strains PA14(pEcdsbA) and pho15(pEcdsbA), respectively.

PA14dsbA$_{Pa}$ was constructed as follows. Based on the dsbA sequences of PAO1 (GenBank Accession No. U84726), primers TMW8 (5'-GCACTGATCGCTGCGTAGCACGGC-3'; SEQ ID NO:177) and TMW9 (5'-TGACGTAGCCGGAACGCAGGCTGC-3'; SEQ ID NO:178) were used to amplify a 1126 bp fragment containing the dsbA gene plus 176 bp upstream of the translational start of the dsbA gene from genomic DNA of PA14. This fragment was cloned., using the TA cloning kit (Invitrogen), into the pCR2.1 vector to generate pCRdsbA. The SacI/XbaI fragment-containing dsbA was cloned into SacI/XbaI digested pUCP18 to construct pPAdsbA, placing the transcription of dsbA under the constitutive lacZ promoter. Strain pho15(PAdsbA) was constructed by transforming pho15 with pPAdsbA$_{Pa}$.

Mutant 25F1. In 25F1, TnphoA was found to be inserted within codon 100 of a putative gene (orf338) that encodes a 338 amino acid protein, the first gene of a putative 3-gene operon. The predicted downstream genes (orf224 and orf252) encode 224 and 252 amino acid proteins, respectively. GAP analysis showed that orf338 is 28.5% identical (37.7% similar) to orfT of C. tepidum (GenBank Accession No. U58313). BLASTP of ORF224 identified mannose-1-phosphate guanylyltransferase (MPG; EC 2.7.7.13) from eukaryotes, archeabacteria, cyanobacteria, and mycobacteria, but not proteobacteria, close relatives of P. aeruginosa. It is not clear if ORF224 is a functional MPG since all known MPGs consist of 359–388 amino acid residues, whereas OFR224 consists of only 224 amino acid residues. ORF252 is homologous to E. coli DjlA$^{Ec}$. DjlA$_{Ec}$ is thought to play a role in the correct assembly, activity and/or maintenance of a number of membrane proteins, including the two-component histidine kinase signal-transduction systems.

To test if orf338 is the gene responsible for reduced pathogenicity in worms, we compared the killing kinetics of a strain carrying orf338 alone, 25F1(pORF338), to wild type PA14 and 25F1 carrying vector alone. The 25F1(pORF338) was constructed as follows.

A 1.8 kb PCR-fragment containing 482 bp upstream promoter sequence, the entire orf338 and a truncated orf224 was amplified (Expand™ High Fidelity System, Boehringer Mannheim) from PA14 genomic DNA using primers F2327 (5'-CGAGGAATCCAGTCGAGGTG-3'; SEQ ID NO:179) and R4180 (5'-GCAAGATGCAGCCGAGAGTAG-3'; SEQ ID NO:180). The product was cloned into vector pCR2.1 (TA Cloning, Invitrogen) to construct plasmid pMT403C-R. The SacI/XbaI fragment from pMT403C-R, which contained the PCR product, was cloned into the SacI/XbaI of pUCP18 to construct pORF338, placing orf338 under the control of its native promoter. 25F1 were transformed with pORF338 to make strain 25F1(pORF338).

In addition, a strain which contained the entire operon (orf338, orf224, and djlA$_{Pa}$) was constructed as follows. A PCR strategy was used to amplify a 3.6 kb genomic fragment containing orf338, orf224, and djlA$_{Pa}$ and their upstream transcriptional sequences using primers RIF3115 (5'-GTCA*GAATTCTCA*GCTTGACGTTGTTGCCC-3'; SEQ ID NO:181) and RIR6757 (5'-GTCA*GAATTCGACT*TCTATTACCGCGACGCC-3'; SEQ ID NO:182). EcoRI sites (underlined) are present in the primers, but absent in the genomic sequence. Both strands of the PCR product were sequenced to determine the sequence of orf338, orf224, and djlA$_{Pa}$, in strain PA14. The PCR EcoRI digestion product was cloned into the EcoRI site of pUCP18, and the orientation of insertion determined by restriction digest. Plasmid p3-ORFs, where orf338, orf224, and djlA$_{Pa}$ are under the control by its native promoter was then used to transform 25F1 to make strain 25F1(p3-ORFs).

As is shown in FIG. 34C, strain 25F1(pORF338) failed to complement fully the slow-killing phenotype. Strain 25F1 (p3-ORFs), which contained the entire operon (orf338, orf224, and djlA$_{Pa}$), also showed only partial complementation of the mutant phenotype. This result indicated that the TnphoA is responsible for the pathogenicity phenotype; partial complementation may be a consequence of gene dosage. The higher mortality achieved by strain 25F1(p3-ORFs) compared to strain 25F1(pORF338) further suggested that the downstream genes, ORF224 and/or DjlA$_{Pa}$ may also play a role in PA14 virulence.

FIG. 24J shows the nucleotide sequence (SEQ ID NO:173) of PA14 25F1 encoding ORFT (SEQ ID NO:174), ORFU (SEQ ID NO:175), and DjlA$_{Pa}$ (SEQ ID NO:176).

Mutant 50E12. The TnphoA insertion in 50E12 was inserted within codon 39 of a predicted 759 amino acid protein that is 43% identical (54% similar) to the PtsP$_{Ec}$ protein of E. coli. Based on sequence analysis, ptsP$_{Ec}$ is predicted to encode Enzyme INtr, a 738 amino acid protein which contains an N-terminal Nif-A domain and a C-terminal Enzyme I domain; the latter functions in the phosphoenolpyruvate-dependent phosphotransferase system. It is thought the Nif-A domain serves a signal transduction function, either directly sensing small molecule signals or receiving signals from a NifL-like protein. Either mechanism may modulate the catalytic activity of the Enzyme I domain; which in turn is suggested to phosphorylate NPr (nitrogen-related HPr) and thereby regulate transcription of RpoN-dependent operons. Immediately upstream of the PA14pts$_{Pa}$ homologue is open reading frame (orf159) predicted to encode a 159 amino acid protein that appears to be co-transcribed with ptsPPa. FIG. 24H shows the nucleotide sequence (SEQ ID NO:168) of PA14 50E12 encoding YgdP$_{Pa}$ (SEQ ID NO:169) and PtsP$_{Pa}$ (SEQ ID NO:170). ORF159 is 62.3–64.8% identical to YgdP proteins of unknown function found in H. influenzae (GenBank Accession No. Q57045) and E. coli (GenBank Accession No. Q46930). These proteins are closely related to invasion protein A in Helicobacter pylori and Bartonella bacilliformis. B. bacilliformis invasion protein A (SwissProt Accession No. P35640) is encoded by ailA, which when present together with an adjacent but independently transcribed gene, ailB, confers on E. coli the ability to invade human erythrocytes.

For the complementation of 50E12, two strains were tested: 50E12(pMT206-lac) and 50E12(pMT206-nat). Strain 50E12(pMT206-lac) carried plasmid pMT206-lac, where the transcription of orf159 and ptsPPa is under the control of the constitutive lacZ promoter. For strain 50E12 (pMT206-nat), the transcription of orf159 and ptsP$_{Pa}$ is controlled only by their native promoter. Each of these strains were constructed as follows.

A 4.3 kb PCR fragment, containing the EcoRI site at both ends was amplified from genomic DNA of P. aeruginosa PA14 using these primers: RIF1698 (5'-GTCAGAATTCGATGTTCCAGTCCCAGATCCC-3'; SEQ ID NO:183) and RIR6002 (5'-

GTCAGAATTCCAGTAGACCACCGCCGAGAG-3': SEQ ID NO:184). This fragment was cloned into the EcoRI site of pUCP18 to make pMT206-lac and pMT206-nat; their identity confirmed by restriction digest. In pMT206-lac, the transcription of orf159 and ptsPPa is under the control of both the constitutive lacZ promoter and their native promoter. Only their native promoter controls the transcription of orf159 and ptsPPa in pMT206-nat.

As is shown in FIG. 34D, both strains partially complemented the mutant phenotype, with the time required by these complemented strains to kill 100% of the worms being longer than the wild-type strain. Partial complementation was observed in the burned-mouse assay: Mortality of mice after infection by $5 \times 10_5$ bacteria from strain 50E12 (pMT206-nat) was 39%, compared to 100% and 0% mortality when infected by the wild-type strain and 50E12, respectively. These results indicated that the putative orf159-ptsP$_{Pa}$ operon is involved in P. aeruginosa pathogenesis in nematode and mice.

Mutant 35A9. The TnphoA insertion in 35A9 is located in a putative 210 amino acid protein (encoded by orf210) that is most closely related (31.5% identity) to the N. gonorrhoeae MtrRNg protein, which belongs to the TetR family of helix-turn-helix containing bacterial transcription regulation proteins. ORF210 is adjacent to, and divergently transcribed from, three genes that are homologous to components of the energy dependent efflux (EDE) system in P. aeruginosa. Analyses of sequences from PA01 showed that together, these four genes defined a novel energy dependent efflux (EDE) system in P. aeruginosa. The other EDE systems in P. aeruginosa described previously are the mexR, mexA-mexB-oprK system, the nfxB, mexC-mexD-oprJ system and the nfxC, mexE-mexF-oprN system. FIG. 24I shows the nucleotide sequence (SEQ ID NO:171) of PA14 35A9 encoding mtrR$_{Pa}$ (SEQ ID NO:172).

Mutants 37H7 and 1D7. Analysis of the IPCR product from mutant 37H7 showed that there is a TnphoA insertion within codon 188 of the 214 amino acid GacA protein. DNA blot analysis showed that 1D7 also contained an insertion in the gacA gene.

Mutant 48D9. TnphoA is inserted between codon 491 and 492 of the 925 amino acid LemA-homologue, a sensor kinase belonging to a family of bacterial two-component regulators. The cognate response regulator of LemA in P. syringae is GacA and GacA+LemA have been shown to affect the expression of a variety number of virulence factors.

Mutant 41C1. TnphoA is inserted in the AefA-homologue of the putative E. coli integral membrane protein (SwissProt P77338) in mutant 41C1. It is a member of the 30–40 kD UPF0003 protein family (PROSITE PDOC00959). In addition to E. coli, it is also present Synechocystis strain PCC 6803 and Methanococcus jannaschii.

In addition, strains pho34B12, 3E8, 8C12, 1G2, 35A9, and 23A2, were also found to have a phenazine-minus mutant phenotype. Moreover, pho34B12, 3E8, 8C12, and 1G2 mutants were found to be reduced in pigment production. An additional mutant, 6A6, was also identified having reduced pigment. The characteristic color of P. aeruginosa strains has been attributed to a group of tricyclic secondary metabolites collectively known as phenazines, the most extensively characterized of which is the blue-green pigment, pyocyanin (1-hydroxy-5-methyl phenazine). In order to test whether the reduction of pigmentation in the bacterial mutants was at least in part due to the reduction in pyocyanin, levels of this pigment were quantified in wild type PA14 as well as in all the mutants obtained using the fast-killing assay. The results of this analysis showed that the pho34B12, 3E8, 8C12, 1G2, and 6A6 mutants that had a reduced pigment phenotype were also reduced in pyocyanin production, with levels ranging from 10 to 50% of the wild type strain. The other mutants, 13C9, 23A2, and 36A4 had levels of pyocyanin comparable with the wild type strain.

In addition, the sequence interrupted by the TnphoA mutation in 3E8 was found to predict a protein with homology to the phzB gene from Pseudomonas fluorescens, that is part of an operon involved in the production of the secondary metabolite, phenazine (GenBank Accession No.: L48616). The phzB gene also has a homolgue in Psuedomonas aureofaciens, referred to as phzY. (GenBank Accession No. AF007801). Using the sequence tag, a cosmid (1G2503), containing this region in the Pseudomonas aeruginosa database was identified, that contains both the phzA and phzB genes, as well as other genes that are thought to play a role in phenazine biosynthesis, the pcnC and D genes (GenBank Accession No. AF005404). Four of these strains, 34B12, 3E8, 23A12, and 35A9, were examined for pathogenicity in the mouse-burn assay. Surprisingly, these experiments showed that the phenazine defective strains have reduced pathogenesis, indicating that the genes interrupted by the TnphoA insertions are mammalian virulence factors. The nucleotide and deduced amino acid sequences, including sequence tags, for these strains are shown in FIGS. 7A–K, 8, 9, 13, 14A–D, 15, 16A, 16B, 17, 18A–F, 22, 24A–L, and 33. In addition, FIGS. 25 and 26 show the nucleotide sequence of the phnA and phnB genes of Pseudomonas aeruginosa and the deduced amino acid sequence of PHNA, respectively.

A detailed description of the DNA sequence and biochemical analyses of each of the mutants identified using the fast-killing assay (described above) is now presented in the following sections.

Mutants 36A4, 23A2, and 13C9. The DNA sequence tags obtained from all three of the mutants that produced wild type levels of pyocyanin, had homologies to known genes in Pseudomonads. Mutant 36A4 contained TnphoA inserted into a gene homologous to hrpM, previously identified as a locus controlling pathogenicity in the plant pathogen Pseudomonas syringae (Mills and Mukhopadhyay, In: Pseudomonas: biotransformations, pathogenesis, and evolving technology, S. Silver, A. M. Chakrabarty, B. Iglewiski, and S. Kaplan, eds, American Society for Microbiology, 1990, pp. 47–57, Mukhopadhyay et al., J. Bacteriol. 170:5479–5488, 1988); GenBank Accession No. 140793). This locus also has homology to the E. coli mdoH gene, which encodes an enzyme involved in the biosynthesis of periplasmic glucans (Loubens et al., Mol. Microbiol. 10:329–340, 1993; GenBank Accession No. X64197). The TnphoA insertion in mutant 23A2 was inserted into a gene previously identified in P. aeruginosa strain PAO1 as mexA (Poole et al., Mol. Microbiol. 10:529–544, 1993; GenBank Accession No. L11616). The product of mexA, predicted to be a cytoplasmic-membrane-associated lipoprotein, likely functions together with the products of the other two genes contained in the same operon, mexB and oprM, as a non-ATPase efflux pump with broad substrate specificity (Li et al., Antimicrob. Agents. Chemother. 39:1948–1953, 1995). Sequence analysis of the DNA flanking the third mutant that was wild type for pigment production, 13C9, showed that it corresponded to another previously known gene in P. aeruginosa strain PAO1, orp (GenBank Accession No. U54794). Orp, or osmoprotectant-dependent regulator of phospholipase C, was identified as a factor controlling the expression of the pathogenicity factor PlcH, one of the two isoforms of phosholipase C produced by *P. aeruginosa* (Sage et al., Mol. Microbiol. 23: 43–56, 1997).

Mutants 1G2 and 8C12. Molecular analysis of two of the non-pigmented mutants 1G2 and 8C12 showed that they contained insertions into novel genes, although DNA flanking the 1G2 insertion contained a motif characteristic of histidine sensor kinases. This gene was not present in the PAO1 genome database. Although the 8C12 sequence tag identified a homologous gene in the PAO1 database, no significant motifs were found within this gene.

Mutants 3E8 and 6A6. Two mutants, 3E8 and 6A6, contained TnphoA insertions into the same gene, which was homologous to the previously identified phzB gene in *P. fluorescens* strain 2–79 (GenBank Accession No. AF007801) and phzY in *P. aureofaciens*, strain 30–84 (GenBank Accession No. L48616). These two mutants contained the TnphoA insertion in exactly the same position, however, they were independent isolates since they were obtained from two different mutant libraries. Although phzB and phzY contained no identifiable sequence motifs, they were present in operons known to regulate production of phenazine-1-carboxylate (PCA) in both *P. fluorescens* and *P. aureofaciens* (Mavrodi et al., *J. Bacteriol.* 180:2541–2548, 1998).

Mutant pho34A12. DNA flanking the TnphoA insertion in the final non-pigmented mutant pho34B12, was previously cloned and shown to be a novel locus as described infra. Interestingly, this insertion is immediately downstream of the phenazine biosynthetic genes, phnA and phnB, as identified in *P. aeruginosa* strain PAO1 (Essar et al., *J. Bacteriol.* 172:884–900, 1990).

Phenazines are Required for Fast Killing of *C. elegans*

The isolation of both pigmented and non-pigmented mutants in the fast-killing screen indicated that the fast-killing process involved more than one factor. However, the molecular analysis of the 3E8 and 6A6 mutants (containing insertions in an operon known to regulate phenazine production) strongly suggested that phenazines represented one class of toxin that mediate fast killing. In order to directly test this hypothesis, an additional mutation, ΔphnA phnB, was generated and studied as follows.

The phenazine biosynthetic genes phnA and phnB (Essar et al., *J. Bacteriol.* 172:884–900, 1990) genes lie upstream of the previously characterized pho34B12 TnphoA insertion in PA14; GenBank Accession No. AF031571). A 3.7 kb EcoRI fragment corresponding to the wild type sequence of this region (from the plasmid pLGR34) was subcloned into pBluescript SK/+ to yield Bs34B12. This plasmid contained 944 bp of phnA (full length of 1591 bp), the entire phnB (600 bp) gene and 1.7 kb of downstream sequences. The missing 605 bp of phnA and 405 bp upstream were amplified using PCR from genomic PA14 DNA with the oligonucleotide primers PHNA3 (5'-GGTCTAGACGAACTGAGCGAGGAG-3'; SEQ ID NO:185) and PHNA2 (5'-GCCTGCAGGCGTTCTACCTG-3'; SEQ ID NO:186). The primers were based on the sequence of the previously cloned phnA and phnB genes from *P. aeruginosa* strain PAO1 (Essar et al., *J. Bacteriol.* 172:884–900, 1990, GenBank Accession No. M33811). The 1010 bp amplified sequence was subcloned into the PstI sites of pBs34B12 to give the construct, pBs34B12phnA. An in-frame deletion within phnA, phnB was generated by replacing 2.6 kb of the wild type sequence of the genes with a 1 kb fragment (FIG. 35) amplified by PCR using the primers PHNDEL1 (5'-GGCTGCAGTGATTGACTG AGCGTCTGCTGGAGAACG-3'; SEQ ID NO:187) and PHNDEL2 (5'-GGGAAGCTTCGTCTAGAA TCACGTGAACATGTTCC-3': SEQ ID NO:188) to yield the plasmid pBs34b12phndel. A 1.8 kb XbaI fragment containing the phnAphnB in-frame deletion was subcloned into the positive-sucrose-selection suicide vector pCVD442 (Donnenberg and Kaper, *Infect. Immun.* 59:4310–4317, 1991). The resulting construct, pCVD34B12phndel, was used to introduce the disrupted phnA, phnB genes into the wild-type PA14 genome by homologous recombination resulting in the mutant PA14 ΔphnAphnB. DNA restriction and DNA blot analyses using DNA from the parental PA14 and derivative PA14 ΔphnAphnB strains were undertaken in order to verify that the mutant contained the desired deletion.

Although little is known about the nature of the enzymes that catalyze the formation of phenazines in *P. aeruginosa* and related Pseudomonads, the conversion of chorismate to anthranilate is thought to be a key step in the pathway (FIG. 35A). In *P. aeruginosa* strain PAO1, this step is most-likely catalyzed by the anthranilate synthase encoded by the phnA and phnB genes, since mutations in these genes result in decreased production of the phenazine pyocyanin (Essar et al., *J. Bacteriol.* 172:884–900, 1990). The phnA and phnB genes were cloned from PA14 and a ΔphnAphnB mutant containing a 1602 bp deletion in these genes was generated (FIG. 35B). Importantly, this mutation was designed to be non-polar and therefore did not affect the two ORFs shown to be directly downstream of phnA and phnB (infra). Measurement of pyocyanin in the ΔphnAphnB mutant showed that it generated only 10% of wild type levels, confirming that phnA and phnB are involved in pyocyanin production in strain PA14 just as in PAO1. Assays conducted using ΔphnAphnB revealed that this strain was severely reduced in fast killing. As seen in FIG. 35C, less than 5% of the worms were dead three hours after exposure to ΔphnAphnB in contrast to almost 100% that were exposed to the wild type strain. The ΔphnAphnB strain behaved in a manner similar to the other phenazine mutant, 3E8, which served as the control for an attenuated mutant in this experiment. These results demonstrated that phenazines are required for the fast killing of *C. elegans*.

To discover whether the bacterial factors that mediated fast killing are relevant to pathogenesis in other hosts, the fast-killing mutants were tested for virulence in the Arabidopsis leaf infiltration model as well as the mouse full thickness skin burn model (infra). Five fast-killing mutants were tested for growth over the course of four days in Arabidopsis leaves as a quantitative measure of their pathogenicity and also in the mouse full thickness skin burn model. As shown in Tables 4 and 5, the maximal level of growth in Arabidopsis leaves on the fourth day postinfection was significantly lower for 2 of the phenazine mutants, 3E8 and 8C12. In the mouse model these two mutants caused significantly less mortality than the wild type strain with a $P<0.05$ when an inoculum of $5\times10^5$ cells was used. The third phenazine mutant 1G2, was not significantly different from the wild type strain in either the plant or the mouse models.

Both the hrpM mutant, 36A4, and the mexA mutant, 23A2, were severely debilitated in growth in Arabidopsis leaves, indicating a strong pathogenicity defect in this model. In the mouse model, mutant 36A4, had a dramatic effect causing no mortality at the dose tested. In contrast, the mexA mutant, 23A2 was only marginally affected. These results demonstrated that the fast killing screen is extremely effective at identifying genes required for pathogenesis in both plants and mice, and further, provide the first in vivo demonstration that phenazines are required for pathogenesis in these two hosts.

We also note that we have identified a regulator, phzR, of the phz operon. FIGS. 18E and 18F shows the nucleotide sequence (SEQ ID NO:164) and predicted partial amino acid sequence (SEQ ID NO:165) of PA14 phzR.

Phenazines and Pathogenesis

PA14 mutants reduced in fast killing also affected pigment synthesis. Our molecular analysis revealed that the association between pigment production and pathogenesis was not simply due to the coordinate regulation of pigmentation and toxin production by regulatory factors. Instead we found that mutations in phenazine biosynthetic genes were reduced in virulence, strongly implicating phenazines as toxins in the fast-killing process. Phenazines, tri-cyclic pigmented compounds that give Pseudomonads their characteristic colors (Turner and Messenger, *Adv. Microb. Physiol.* 27:211–273, 1986), are secondary metabolites thought to increase the survival of organisms under competitive conditions (Maplestone et al., *Gene* 115:151–157, 1992). Although the repertoire of phenazines produced by PA14 is unknown, *P. aeruginosa* strain PAO1 produces at least six different phenazines, including the well characterized blue-green pigment pyocyanin. Phenazines including pyocyanin, have been demonstrated to have antibiotic action against several species of bacteria, fungi, and protozoa, a quality attributed to their redox active. In their highly-reactive reduced state, phenazines have been described to undergo redox cycling in the the presence of various reducing agents or molecular oxygen resulting in the formation of superoxide and hydrogen peroxide (Hassan and Fridovich, *J. Bacteriol.* 141:1556–163, 1980). In vitro, these moderately cytotoxic oxygen radicals can be converted by an iron catalyst to the highly cytotoxic hydroxyl radical (Britigan et al., J. Cln. Invest. 90:2187–2196, 1992). Formation of reactive oxygen species by phenazines is also thought to contribute to their cytotoxic effects observed on eukaryotic cells in vitro. These effects include the inhibition of mammalian cell respiration, the disruption of ciliary beating, and immunomodulatory effects such as stimulation of the inflammatory response, inhibition of lymphocyte proliferation and alteration of the T lymphocyte response to antigens.

The biosynthetic pathways leading to the production of phenazines in *P. aeruginosa* have been poorly defined making it difficult to identify the steps in the pathway blocked by the PA14 mutants defective in phenazine production. However, the transposon insertion in two mutants, 3E8 and 6A6, disrupted a gene with homology to phzB, which was previously characterized as being involved in phenazine production in the related Pseudomonads, *P. fluorescens*, and *P. aureofaciens*. In *P. fluorescens*, phzB was shown to be part of a seven gene operon (phzA-G) involved in the production of phenazine-1-carboxylic acid. Comparison of this operon in *P. flourescens* and *P. aureofaciens* showed that the two were highly homologous, suggesting that pathways leading to phenazine production are conserved in fluorescent Pseudomonads (Mavrodi et al, *J. Bacteriol.* 180:2541–2548, 1998). Although the DNA flanking the phzA and phzB genes has only been partially sequenced in *P. aeruginosa* strain PA14, our analysis suggests that the region shares a conserved structure with the *P. fluorescens* phzA-F operon. The predicted translated products of the phzA and phzB genes from PA14 and *P. fluorescens* share 68 and 74% identity, respectively. In addition, a region containing phzA-F-like genes is present in *P. aeruginosa* strain PAO 1, and the predicted translated products of these genes exhibited between 69 to 85% identity with their *P. fluorescens* homologs (GenBank Accession No. AF005404). Extrapolating from the role of the phz operon in *P. fluorescens* and *P. aureofaciens*, the isolation of PA14 phzB mutants that are defective in fast killing strongly suggested that phenazines are involved in this process. The hypothesis that phenazines, including pyocyanin, are one of the mediators of fast killing was further tested by the non-polar disruption of the genes, phnA and phnB, which encode the two subunits of an anthranilate synthase, previously shown to be specifically involved in phenazine synthesis in *P. aeruginosa* strain PAO1 (Essar et al., *J. Bacteriol.* 172:884–990, 1990). Consistent with a role in phenazine biosynthesis, deletion of the phnA and phnB genes in PA14 severely reduced pyocyanin production. Furthermore, the ΔphnAphnB mutant was defective in fast killing, demonstrating the critical role of phenazines in this process.

The role of phenazines in pathogenesis was also examined in Arabidopsis and mice. The two independent mutants containing insertions within the phzB gene, 3E8, and 6A6, were dramatically reduced in pathogenicity in both the Arabidopsis leaf infiltration model as well as the mouse full thickness skin burn model (Tables 4 and 5), suggesting that phenazines are multi-host pathogencity factors. It is interesting to note that many of the other multi-host pathogenicity factors identified in this and our previous studies are likely to be involved in the production of several other virulence factors and are not effectors, or molecules that directly interact with the host (described infra). Thus, phenazines represent the only known class of multi-host pathogenicity effectors that we have identified. These findings are also significant since despite intensive in vitro analyses of phenazines, the physiological significance of their production and their role in *P. aeruginosa* infections remains controversial, and prior to this study there has been no demonstration of their role in vivo.

Fast killing is Multifactorial

Analysis of fast-killing mutants that generated wild-type levels of pigments showed that although phenazines were essential mediators of fast killing, other factors were involved in this process. Molecular analysis of one such mutant, 23A2, revealed that the transposon was inserted into a gene previously identified in *P. aeruginosa* strain PAO1 as MexA, which is part of the 3 gene operon MexA, B, OprM (Poole et al., *Mol. Microbiol.* 10:529–544, 1993). The products of these genes are localized to the cytoplasmic (MexA, MexB) and outer membranes (OprM) where they are proposed to function as a non-ATPase broad-specificity efflux pump (Li et al., *Antimicrob. Agents Chemother.* 39:1948–1953,1995). Originally identified due to its contribution to the process of multi-drug resistance in *P. aeruginosa*, this pump is thought to play a general role in the export of secondary metabolites, although its natural substrates remain unknown (Poole, *Antimicrob. Agents Chemother.* 34:453–456, 1994). The defect of mexA mutant in fast killing, a process mediated by diffusible toxins, is most-likely due to the lack of export of one or more factors involved in this process. Since the mexA mutant was pigmented., phenazines are not likely to be a substrate for the pump. In addition to its defect in fast killing, the mexA mutant was marginally reduced in pathogenicity in the mouse model and severely debilitated in the Arabidopsis leaf infiltration model. Although the lack of export of specific virulence factors could explain these defects, an additional model is that the mexA mutant bacteria are unable to protect themselves against host defense factors generated in response to the bacterial infection. Such a protective function has been demonstrated for the sap genes, which encode proteins related to ATP binding cassette (ABC) transporters and mediate resistance to host antimicrobial peptides in the human pathogen, *Salmonella typhimurium*, as well as in the phytopathogen, *Erwinia chrysanthemi* (Taylor, *Plant Cell* 10:873–875, 1998).

A second mutant identified in the screen, 36A4, contained a transposon insertion into a gene with homology to *E. coli* MdoH, which is part of the mdoGH operon. In *E. coli*, the products of this operon are involved in the synthesis of membrane-derived oligosaccharides (MDO) or linear, periplasmic glucans (Loubens et al, *Mol. Microbiol.* 10:329–340, 1993). A similar locus, termed hrpM is present in the plant pathogen *Pseudomonas syringae* pv. *syringae* (Mukhopadhyay et al., *J. Bacteriol.* 170:5479–5488, 1988), originally identified since mutations within this locus abolish both the development of disease symptoms on host plants as well as the hypersensitive response in non-host plants (Anderson and Mills, *Phytopath.* 75:104–108, 1985).

Periplasmic glucans have also been found in a wide range of gram-negative bacteria, where diverse, albeit poorly understood functions have been assigned to them. In addition to being essential virulence factors in *P. syringae*, other functions include the adaptation to hypoosmotic environments, and cell signaling leading to the recognition of eukaryotic hosts by species of Rhizobium and Agrobacterium (Kennedy, In: *Escherichia and Salmonella*, F. C. Neidardt, ed., American Society for Microbiology Press, Washington, D.C., pp. 1064–1071, 1996). However, despite being present in the periplasm of several animal pathogens such as Salmonella and Klebsiella, until this study, which shows that *P. aeruginosa* carrying a mutation in an mdoH-like locus is severely reduced in pathogenicity in a mouse model, periplasmic glucans have not been shown to play a role in the infection of animal hosts.

TABLE 4

Summary for Pathogenicity of *P. aeruginosa* strain UCBPP-PA14 mutants on various hosts
Pathogenicity Phenotypes

| Strain Isolation Number | Strain Name | Growth in Arabidopsis Leaf[b] | Ability to kill *C. elegans*[c] | % Mouse Mortality $5 \times 10^{5d}$ | Gene Identity |
| --- | --- | --- | --- | --- | --- |
| PA14 | PA14 | $5.5 \times 10^7$ | + | 100 | |
| rep (reduced pathogenicity in plants) | | | | | |
| 16G12 | rep1 | $2.3 \times 10^5$ | + | 100 | no matches |
| 49H2 | rep2 | $1.2 \times 10^6$ | + | 63 | not sequenced |
| 16G12 | rep1 | $2.3 \times 10^5$ | + | 100 | no matches |
| 25A12 | rep3 | $1.7 \times 10^6$ | + | 75 | no matches |
| 33A9 | rep4 | $5.1 \times 10^6$ | + | 0 | no matches |
| 33C7 | rep5 | $8.4 \times 10^5$ | + | 0 | no matches |
| ren (reduced pathogenicity in nematodes) | | | | | |
| 35A9[g] | ren1 | $5.7 \times 10^7$ | – | 55 | mtrR |
| 44B1 | ren2 | $5.4 \times 10^7$ | – | 56 | no matches |
| 1G2[f,g,h] | | NT | – | NT | no matches |
| 8C12[f,g,h] | | NT | – | NT | no matches |
| 2A8[f,h] | | NT | – | NT | no matches |
| rpn (reduced pathogenicity in plants and nematodes) | | | | | |
| 25F1 | rpn1 | $1.5 \times 10^4$ | – | 20 | orfT |
| 35H7[e] | rpn2 | $1.2 \times 10^4$ | – | NT[e] | gacA |
| 41A5 | rpn3 | $1.3 \times 10^4$ | – | 100 | no matches |
| 41C1 | rpn4 | $2.4 \times 10^5$ | – | 85 | aefA |
| 50E12 | rpn5 | $2.0 \times 10^5$ | – | 0 | ptsP |
| pho15 | rpn6 | $3.9 \times 10^4$ | – | 62 | dsbA |
| 12A1 | rpn7 | $1.7 \times 10^6$ | – | 50 | lasR |
| pho23 | rpn8 | $6.4 \times 10^4$ | – | 5 | no matches |
| 34B12[g,h] | rpn11 | $4.0 \times 10^4$ | – | 50 | dst* of phnB |
| 34H4 | rpn12 | $3.8 \times 10^6$ | – | 50 | no matches |
| 3E8[g,h] | rpn 13 | $1 \times 10^6$ | – | 12.5 | phzB |
| 23A2[h] | rpn14 | $1.7 \times 10^5$ | – | 71 | mexA |
| 36A4[h] | rpn15 | $4 \times 10^4$ | – | 0 | hrpN |

[b]CFU/cm² leaf area of bacterial counts at four days after inoculation of 10³ bacteria: means of four to five samples. Mutants are defined as less pathogenic when the means of four to five samples. Mutants are defined as less pathogenic when the mean CFU/cm² leaf area of bacterial counts is 2 standard deviation lower relative to wild-type within the same set of experiments.
[c]A mutant is considered attenuated in nematode pathogenicity (–) if the mean time required to kill 50% of the worms feeding on it ($LT_{50}$ from 3 replicates) is two standard deviations less than the $LT_{50}$ of parental UCBPP-PA14 in the same experiment; for calculations of $LT_{50}$ see Materials and Methods.
[d]Six-week old male ARK/J inbred strain mice (from Jackson Laboratories), weighing between 20 to 30 gm were injected with $5 \times 10^5$ cells as described by Stevens et al., J. of Burn Care and Rehabil. 15:232–235, 1994. The number of animals that died of sepsis was monitored each day for ten days.
[e]Two other independently isolated gacA mutants are ID7 (rpn9) and 33D11 (rpn10). Mutant rpn9 has been tested on mice and showed 50% mortality
[f]tested only in nematodes
[g]phenazine-defective mutants
[h]mutants defective in fast killing, not affected in slow killing
dst* = downstream

TABLE 5

Pathogenicity of PA14 Fast Killing Mutants in Plants and Mice

| Strain | Growth in Arabidopsis leaves[a] | % Mouse Mortality (n) $5 \times 10^{5b}$ | Gene Identity |
|---|---|---|---|
| PA14 | $7 \times 10^8$ | 100 (>16) | |
| JG2 | $3 \times 10^7$ | 100 (8) | no matches, contains histidine kinase motif |
| 3E8, 6A6 | $3 \times 10^5$ | 18 (16) | phzB |
| 8C12 | $5 \times 10^5$ | 63 (8) | no matches |
| 23A2 | $1.2 \times 10^4$ | 85 (16) | mexA |
| 36A4 | $2 \times 10^4$ | 0 (16) | hrpM |

[a]CFU/cm² leaf area of bacterial counts at five days post-inoculation with 10³ bacteria. Values represent means of four to five samples. Mutants are defined as less pathogenic when the mean value of bacterial counts is two standard deviations lower than the wild type within the same experimental set.
[b]Six-week old male AKR/J inbred mice (from Jackson laboratories), weighing between 20 to 30 gm were injected with $5 \times 10^5$ bacterial cells. (n) is the total number of mice injected. The number of mice that died of sepsis was monitored daily for seven days.
[c]3E8 and 6A6 are independently generated mutants that contain TnphoA inserted in exactly the same location. The numbers reported are those obtained using 3E8. Similar results were obtained with 6A6 (data not shown).

Isolation of Additional Virulence Genes

Based on the nucleotide and amino acid sequences described herein (see, for example, FIGS. 3-1 to 3-39, 4-1 to 4-22, 29, and 30), the isolation of additional coding sequences of virulence factors is made possible using standard strategies and techniques that are well known in the art. Any pathogenic cell can serve as the nucleic acid source for the molecular cloning of such a virulence gene, and these sequences are identified as ones encoding a protein exhibiting pathogenicity-associated structures, properties, or activities.

In one particular example of such an isolation technique, any one of the nucleotide sequences described herein may be used., together with conventional screening methods of nucleic acid hybridization screening. Such hybridization techniques and screening procedures are well known to those skilled in the art and are described., for example, in Benton and Davis (*Science* 196:180, 1977); Grunstein and Hogness (*Proc. Natl. Acad. Sci., USA* 72:3961, 1975); Ausubel et al. (*Current Protocols in Molecular Biology*, Wiley Interscience, New York, 1997); Berger and Kimmel (supra); and Sambrook et al., *Molecular Cloning: A Laboratory Manual*, Cold Spring Harbor Laboratory Press, New York. In one particular example, all or part of the 33A9 sequence (described herein) may be used as a probe to screen a recombinant plant DNA library for genes having sequence identity to the 33A9 gene (FIGS. 5 and 6A–U). Hybridizing sequences are detected by plaque or colony hybridization according to standard methods.

Alternatively, using all or a portion of the amino acid sequence of the 33A9 polypeptide, one may readily design 33A9-specific oligonucleotide probes, including degenerate oligonucleotide probes (i.e., a mixture of all possible coding sequences for a given amino acid sequence). These oligonucleotides may be based upon the sequence of either DNA strand and any appropriate portion of the 33A9 sequence (FIGS. 5 and 6A–U;, SEQ ID NOs:102 and 103, respectively) of the 33A9 protein. General methods for designing and preparing such probes are provided., for example, in Ausubel et al. (supra), and Berger and Kimmel, Guide to Molecular Cloning Techniques, 1987, Academic Press, New York. These oligonucleotides are useful for 33A9 gene isolation, either through their use as probes capable of hybridizing to 33A9 complementary sequences or as primers for various amplification techniques, for example, polymerase chain reaction (PCR) cloning strategies. If desired., a combination of different, detectably-labelled oligonucleotide probes may be used for the screening of a recombinant DNA library. Such libraries are prepared according to methods well known in the art, for example, as described in Ausubel et al. (supra), or they may be obtained from commercial sources.

As discussed above, sequence-specific oligonucleotides may also be used as primers in amplification cloning strategies, for example, using PCR. PCR methods are well known in the art and are described., for example, in *PCR Technology*, Erlich, ed., Stockton Press, London, 1989; *PCR Protocols: A Guide to Methods and Applications*, Innis et al., eds., Academic Press, Inc, New York, 1990; and Ausubel et al. (supra). Primers are optionally designed to allow cloning of the amplified product into a suitable vector, for example, by including appropriate restriction sites at the 5' and 3' ends of the amplified fragment (as described herein). If desired., nucleotide sequences may be isolated using the PCR "RACE" technique, or Rapid Amplification of cDNA Ends (see, e.g., Innis et al. (supra)). By this method, oligonucleotide primers based on a desired sequence are oriented in the 3' and 5' directions and are used to generate overlapping PCR fragments. These overlapping 3'- and 5'-end RACE products are combined to produce an intact full-length cDNA. This method is described in Innis et al. (supra); and Frohman et al, *Proc. Natl. Acad. Sci. USA* 85:8998, 1988.

Partial virulence sequences, e.g., sequence tags, are also useful as hybridization probes for identifying full-length sequences, as well as for screening databases for identifying previously unidentified related virulence genes. For example, the sequences of 36A4, 25A12, and 33C7 were expanded to those encompassed by contigs 2507, 1126, and 1344, respectively (FIGS. 31 and 32A–I).

Confirmation of a sequence's relatedness to a pathogenicity polypeptide may be accomplished by a variety of conventional methods including, but not limited to, functional complementation assays and sequence comparison of the gene and its expressed product. In addition, the activity of the gene product may be evaluated according to any of the techniques described herein, for example, the functional or immunological properties of its encoded product.

Once an appropriate sequence is identified., it is cloned according to standard methods and may be used., for example, for screening compounds that reduce the virulence of a pathogen.

Polypeptide Expression

In general, polypeptides of the invention may be produced by transformation of a suitable host cell with all or part of a polypeptide-encoding nucleic acid molecule or fragment thereof in a suitable expression vehicle.

Those skilled in the field of molecular biology will understand that any of a wide variety of expression systems may be used to provide the recombinant protein. The precise host cell used is not critical to the invention. A polypeptide of the invention may be produced in a prokaryotic host (e.g., *E. coli*) or in a eukaryotic host (e.g., Saccharomyces cerevisiae, insect cells, e.g., Sf21 cells, or maimalian cells, e.g., NIH 3T3, HeLa, or preferably COS cells). Such cells are available from a wide range of sources (e.g., the American Type Culture Collection, Rockland, Md.; also, see, e.g., Ausubel et al., supra). The method of transformation or transfection and the choice of expression vehicle will depend on the host system selected. Transformation and transfection methods are described., e.g., in Ausubel et al.

(supra); expression vehicles may be chosen from those provided., e.g., in *Cloning Vectors: A Laboratory Manual* (P. H. Pouwels et al., 1985, Supp. 1987).

One particular bacterial expression system for polypeptide production is the *E. coli* pET expression system (Novagen, Inc., Madison, Wis.). According to this expression system, DNA encoding a polypeptide is inserted into a pET vector in an orientation designed to allow expression. Since the gene encoding such a polypeptide is under the control of the T7 regulatory signals, expression of the polypeptide is achieved by inducing the expression of T7 RNA polymerase in the host cell. This is typically achieved using host strains which express T7 RNA polymerase in response to IPTG induction. Once produced., recombinant polypeptide is then isolated according to standard methods known in the art, for example, those described herein.

Another bacterial expression system for polypeptide production is the pGEX expression system (Pharmacia). This system employs a GST gene fusion system which is designed for high-level expression of genes or gene fragments as fusion proteins with rapid purification and recovery of functional gene products. The protein of interest is fused to the carboxyl terminus of the glutathione S-transferase protein from *Schistosoma japonicum* and is readily purified from bacterial lysates by affinity chromatography using Glutathione Sepharose 4B. Fusion proteins can be recovered under mild conditions by elution with glutathione. Cleavage of the glutathione S-transferase domain from the fusion protein is facilitated by the presence of recognition sites for site-specific proteases upstream of this domain. For example, proteins expressed in pGEX-2T plasmids may be cleaved with thrombin; those expressed in pGEX-3X may be cleaved with factor Xa.

Once the recombinant polypeptide of the invention is expressed., it is isolated., e.g., using affinity chromatography. In one example, an antibody (e.g., produced as described herein) raised against a polypetide of the invention may be attached to a column and used to isolate the recombinant polypeptide. Lysis and fractionation of polypeptide-harboring cells prior to affinity chromatography may be performed by standard methods (see, e.g., Ausubel et al., supra).

Once isolated., the recombinant protein can, if desired., be further purified., e.g., by high performance liquid chromatography (see, e.g., Fisher, *Laboratory Techniques In Biochemistry And Molecular Biology*, eds., Work and Burdon, Elsevier, 1980).

Polypeptides of the invention, particularly short peptide fragments, can also be produced by chemical synthesis (e.g., by the methods described in *Solid Phase Peptide Synthesis*, 2nd ed., 1984 The Pierce Chemical Co., Rockford, Ill.).

These general techniques of polypeptide expression and purification can also be used to produce and isolate useful peptide fragments or analogs (described herein).

Antibodies

To generate antibodies, a coding sequence for a polypeptide of the invention may be expressed as a C-terminal fusion with glutathione S-transferase (GST) (Smith et al, *Gene* 67:31–40, 1988). The fusion protein is purified on glutathione-Sepharose beads, eluted with glutathione, cleaved with thrombin (at the engineered cleavage site), and purified to the degree necessary for immunization of rabbits. Primary immunizations are carried out with Freund's complete adjuvant and subsequent immunizations with Freund's incomplete adjuvant. Antibody titres are monitored by Western blot and immunoprecipitation analyses using the thrombin-cleaved protein fragment of the GST fusion protein. Immune sera are affinity purified using CNBr-Sepharose-coupled protein. Antiserum specificity is determined using a panel of unrelated GST proteins.

As an alternate or adjunct immunogen to GST fusion proteins, peptides corresponding to relatively unique immunogenic regions of a polypeptide of the invention may be generated and coupled to keyhole limpet hemocyanin (KLH) through an introduced C-terminal lysine. Antiserum to each of these peptides is similarly affinity purified on peptides conjugated to BSA, and specificity tested in ELISA and Western blots using peptide conjugates, and by Western blot and immunoprecipitation using the polypeptide expressed as a GST fusion protein.

Alternatively, monoclonal antibodies which specifically bind any one of the polypeptides of the invention are prepared according to standard hybridoma technology (see, e.g., Kohler et al., *Nature* 256:495, 1975; Kohler et al., *Eur. J. Immunol.* 6:511, 1976; Kohler et al., *Eur. J. Immunol.* 6:292, 1976; Hammerling et al., In *Monoclonal Antibodies and T Cell Hybridomas*, Elsevier, N.Y., 1981; Ausubel et al., supra). Once produced., monoclonal antibodies are also tested for specific recognition by Western blot or immunoprecipitation analysis (by the methods described in Ausubel et al., supra). Antibodies which specifically recognize the polypeptide of the invention are considered to be useful in the invention; such antibodies may be used., e.g., in an immunoassay. Alternatively monoclonal antibodies may be prepared using the polypeptide of the invention described above and a phage display library (Vaughan et al., *Nature Biotech* 14:309–314, 1996).

Preferably, antibodies of the invention are produced using fragments of the polypeptide of the invention which lie outside generally conserved regions and appear likely to be antigenic, by criteria such as high frequency of charged residues. In one specific example, such fragments are generated by standard techniques of PCR and cloned into the pGEX expression vector (Ausubel et al., supra). Fusion proteins are expressed in *E. coli* and purified using a glutathione agarose affinity matrix as described in Ausubel et al. (supra). To attempt to minimize the potential problems of low affinity or specificity of antisera, two or three such fusions are generated for each protein, and each fusion is injected into at least two rabbits. Antisera are raised by injections in a series, preferably including at least three booster injections.

Antibodies against any of the polypeptides described herein may be employed to treat bacterial infections.

Screening Assays

As discussed above, we have identified a number of *P. aeruginosa* virulence factors that are involved in pathogenicity and that may therefore be used to screen for compounds that reduce the virulence of that organism, as well as other microbial pathogens. For example, the invention provides methods of screening compounds to identify those which enhance (agonist) or block (antagonist) the action of a polypeptide or the gene expression of a nucleic acid sequence of the invention. The method of screening may involve high-throughput techniques.

Any number of methods are available for carrying out such screening assays. According to one approach, candidate compounds are added at varying concentrations to the culture medium of pathogenic cells expressing one of the nucleic acid sequences of the invention. Gene expression is then measured., for example, by standard Northern blot analysis (Ausubel et al., supra), using any appropriate fragment prepared from the nucleic acid molecule as a hybridization probe. The level of gene expression in the presence of the candidate compound is compared to the level measured in a control culture medium lacking the candidate molecule. A compound which promotes a decrease in the expression of the pathogenicity factor is considered useful in the invention; such a molecule may be used., for example, as a therapeutic to combat the pathogenicity of an infectious organism.

If desired., the effect of candidate compounds may, in the alternative, be measured at the level of polypeptide production using the same general approach and standard immunological techniques, such as Western blotting or immunoprecipitation with an antibody specific for a pathogenicity factor. For example, immunoassays may be used to detect or monitor the expression of at least one of the polypeptides of the invention in a pathogenic organism. Polyclonal or monoclonal antibodies (produced as described above) which are capable of binding to such a polypeptide may be used in any standard immunoassay format (e.g., ELISA, Western blot, or RIA assay) to measure the level of the pathogenicity polypeptide. A compound which promotes a decrease in the expression of the pathogenicity polypeptide is considered particularly useful. Again, such a molecule may be used., for example, as a therapeutic to combat the pathogenicity of an infectious organism.

Alternatively, or in addition, candidate compounds may be screened for those which specifically bind to and inhibit a pathogenicity polypeptide of the invention. The efficacy of such a candidate compound is dependent upon its ability to interact with the pathogenicity polypeptide. Such an interaction can be readily assayed using any number of standard binding techniques and functional assays (e.g., those described in Ausubel et al, supra). For example, a candidate compound may be tested in vitro for interaction and binding with a polypeptide of the invention and its ability to modulate pathogenicity may be assayed by any standard assays (e.g., those described herein).

In one particular example, a candidate compound that binds to a pathogenicity polypeptide may be identified using a chromatography-based technique. For example, a recombinant polypeptide of the invention may be purified by standard techniques from cells engineered to express the polypeptide (e.g., those described above) and may be immobilized on a column. A solution of candidate compounds is then passed through the column, and a compound specific for the pathogenicity polypeptide is identified on the basis of its ability to bind to the pathogenicity polypeptide and be immobilized on the column. To isolate the compound, the column is washed to remove non-specifically bound molecules, and the compound of interest is then released from the column and collected. Compounds isolated by this method (or any other appropriate method) may, if desired., be further purified (e.g., by high performance liquid chromatography). In addition, these candidate compounds may be tested for their ability to render a pathogen less virulent (e.g., as described herein). Compounds isolated by this approach may also be used., for example, as therapeutics to treat or prevent the onset of a pathogenic infection, disease, or both. Compounds which are identified as binding to pathogenicity polypeptides with an affinity constant less than or equal to 10 mM are considered particularly useful in the invention.

In yet another approach, candidate compounds are screened for the ability to inhibit the virulence of a *P. seudomonas* cell by monitoring the effect of the compound on the production of a phenazine (e.g., pyocyanin). According to one approach, candidate compounds are added at varying concentrations to a culture medium of pathogenic cells. Pyocyanin is then measured according to any standard method, for example, by monitoring its absorbance at 520 nn in acidic solution (Essar et al., *J. Bacteriol.* 172: 884, 1990). To maximize pyocyanin production in liquid culture for quantitation, cells may be cultured in a modified KA broth (King et al., *J. Lab. Clin. Med.* 44:301, 1954) by adding 100 $\mu$M $FeCl_3$. The level of pyocyanin production in the presence of the candidate compound is compared to the level measured in a control culture medium lacking the candidate molecule. A compound which promotes a decrease in the expression of a pyocyanin is considered useful in the invention; such a molecule may be used., for example, as a therapeutic to combat the pathogenicity of an infectious organism. Similar techniques may also be used to screen for other appropriate phenazines including, without limitation, pyorubin, aeruginosin A, myxin, and tubermycin A. Other phenazines are described in Turner and Messenger (*Advances In Microbial Physiology* 27:211–1275, 1986), Sorensen and Joseph (In: *Pseudomonas aeruginosa as an Opportunistic Pathogen*, Campa, M., ed., Plenum Press, N.Y., 1993), Ingram and Blackwood (*Advances in Applied Microbiology* 13: 267, 1970), and Gerber (In: CRC Handbook of Microbiology, Laskin, A. I, and Lechevalier, eds., $2^{nd}$ edition, vol. 5, Chemical Rubber Co., Cleveland, Ohio, 1984, pp. 573–576).

Potential antagonists include organic molecules, peptides, peptide mimetics, polypeptides, and antibodies that bind to a nucleic acid sequence or polypeptide of the invention and thereby inhibit or extinguish its activity. Potential antagonists also include small molecules that bind to and occupy the binding site of the polypeptide thereby preventing binding to cellular binding molecules, such that normal biological activity is prevented. Other potential antagonists include antisense molecules.

Each of the DNA sequences provided herein may also be used in the discovery and development of antipathogenic compounds (e.g., antibiotics). The encoded protein, upon expression, can be used as a target for the screening of antibacterial drugs. Additionally, the DNA sequences encoding the amino terminal regions of the encoded protein or Shine-Delgarno or other translation facilitating sequences of the respective mRNA can be used to construct antisense sequences to control the expression of the coding sequence of interest.

The invention also provides the use of the polypeptide, polynucleotide, or inhibitor of the invention to interfere with the initial physical interaction between a pathogen and mammalian host responsible for infection. In particular the molecules of the invention may be used: in the prevention of adhesion and colonization of bacteria to mammalian extracellular matrix proteins; to extracellular matrix proteins in wounds; to block mammalian cell invasion; or to block the normal progression of pathogenesis.

The antagonists and agonists of the invention may be employed., for instance, to inhibit and treat a variety of bacterial infections.

Optionally, compounds identified in any of the above-described assays may be confirmed as useful in conferring protection against the development of a pathogenic infection in any standard animal model (e.g., the mouse-burn assay described herein) and, if successful, may be used as anti-pathogen therapeutics (e.g., antibiotics).

Test Compounds and Extracts

In general, compounds capable of reducing pathogenic virulence are identified from large libraries of both natural product or synthetic (or semi-synthetic) extracts or chemical libraries according to methods known in the art. Those skilled in the field of drug discovery and development will understand that the precise source of test extracts or compounds is not critical to the screening procedure(s) of the invention. Accordingly, virtually any number of chemical extracts or compounds can be screened using the methods described herein. Examples of such extracts or compounds include, but are not limited to, plant-, fungal-, prokaryotic- or animal-based extracts, fermentation broths, and synthetic compounds, as well as modification of existing compounds. Numerous methods are also available for generating random or directed synthesis (e.g., semi-synthesis or total synthesis) of any number of chemical compounds, including, but not limited to, saccharide-, lipid-, peptide-, and nucleic acid-based compounds. Synthetic compound libraries are commercially available from Brandon Associates (Merrimack, NH) and Aldrich Chemical (Milwaukee, Wis.). Alternatively, libraries of natural compounds in the form of bacterial, fungal, plant, and animal extracts are commercially available from a number of sources, including Biotics (Sussex, UK), Xenova (Slough, UK), Harbor Branch Oceangraphics Institute (Ft. Pierce, Fla.), and PharmnaMar, U.S.A. (Cambridge, Mass.). In addition, natural and synthetically produced libraries are produced., if desired., according to methods known in the art, e.g., by standard extraction and fractionation methods. Furthermore, if desired., any library or compound is readily modified using standard chemical, physical, or biochemical methods.

In addition, those skilled in the art of drug discovery and development readily understand that methods for dereplication (e.g., taxonomic dereplication, biological dereplication, and chemical dereplication, or any combination thereof) or the elimination of replicates or repeats of materials already known for their anti-pathogenic activity should be employed whenever possible.

When a crude extract is found to have an anti-pathogenic or anti-virulence activity, or a binding activity, further fractionation of the positive lead extract is necessary to isolate chemical constituents responsible for the observed effect. Thus, the goal of the extraction, fractionation, and purification process is the careful characterization and identification of a chemical entity within the crude extract having anti-pathogenic activity. Methods of fractionation and purification of such heterogenous extracts are known in the art. If desired., compounds shown to be useful agents for the treatment of pathogenicity are chemically modified according to methods known in the art.

Pharmaceutical Therapeutics and Plant Protectants

The invention provides a simple means for identifying compounds (including peptides, small molecule inhibitors, and mimetics) capable of inhibiting the pathogenicity or virulence of a pathogen. Accordingly, a chemical entity discovered to have medicinal or agricultural value using the methods described herein are useful as either drugs, plant protectants, or as information for structural modification of existing anti-pathogenic compounds, e.g., by rational drug design. Such methods are useful for screening compounds having an effect on a variety of pathogens including, but not limited to, bacteria, viruses, fungi, annelids, nematodes, platyhelminthes, and protozoans. Examples of pathogenic bacteria include, without limitation, Aerobacter, Aeromonas, Acinetobacter, Agrobacterium, Bacillus, Bacteroides, Bartonella, Bortella, Brucella, Calymmatobacterium, Campylobacter, Citrobacter, Clostridium, Cornyebacterium, Enterobacter, Escherichia, Francisella, Haemophilus, Hafnia, Helicobacter, Klebsiella, Legionella, Listeria, Morganella, Moraxella, Proteus, Providencia, Pseudomonas, Salmonella, Serratia, Shigella, Staphylococcus, Streptococcus, Treponema, Xanthomonas, Vibrio, and Yersinia.

For therapeutic uses, the compositions or agents identified using the methods disclosed herein may be administered systemically, for example, formulated in a pharmaceutically-acceptable buffer such as physiological saline. Treatment may be accomplished directly, e.g., by treating the animal with antagonists which disrupt, suppress, attenuate, or neutralize the biological events associated with a pathogenicity polypeptide. Preferable routes of administration include, for example, subcutaneous, intravenous, interperitoneally, intramuscular, or intradermal injections which provide continuous, sustained levels of the drug in the patient. Treatment of human patients or other animals will be carried out using a therapeutically effective amount of an anti-pathogenic agent in a physiologically-acceptable carrier. Suitable carriers and their formulation are described., for example, in Remington's *Pharmaceutical Sciences* by E. W. Martin. The amount of the anti-pathogenic agent (e.g., an antibiotic) to be administered varies depending upon the manner of administration, the age and body weight of the patient, and with the type of disease and extensiveness of the disease. Generally, amounts will be in the range of those used for other agents used in the treatment of other microbial diseases, although in certain instances lower amounts will be needed because of the increased specificity of the compound. A compound is administered at a dosage that inhibits microbial proliferation. For example, for systemic administration a compound is administered typically in the range of 0.1 ng–10 g/kg body weight.

For agricultural uses, the compositions or agents identified using the methods disclosed herein may be used as chemicals applied as sprays or dusts on the foliage of plants. Typically, such agents are to be administered on the surface of the plant in advance of the pathogen in order to prevent infection. Seeds., bulbs, roots, tubers, and corns are also treated to prevent pathogenic attack after planting by controlling pathogens carried on them or existing in the soil at the planting site. Soil to be planted with vegetables, ornamentals, shrubs, or trees can also be treated with chemical fumigants for control of a variety of microbial pathogens. Treatment is preferably done several days or weeks before planting. The chemicals can be applied by either a mechanized route, e.g., a tractor or with hand applications. In addition, chemicals identified using the methods of the assay can be used as disinfectants.

OTHER EMBODIMENTS

In general, the invention includes any nucleic acid sequence which may be isolated as described herein or which is readily isolated by homology screening or PCR amplification using the nucleic acid sequences of the invention. Also included in the invention are polypeptides which are modified in ways which do not abolish their pathogenic activity (assayed., for example as described herein). Such changes may include certain mutations, deletions, insertions, or post-translational modifications, or may involve the inclusion of any of the polypeptides of the invention as one component of a larger fusion protein. Also, included in the invention are polypeptides that have lost their pathogenicity.

Thus, in other embodiments, the invention includes any protein which is substantially identical to a polypeptide of the invention. Such homologs include other substantially pure naturally-occurring polypeptides as well as allelic variants; natural mutants; induced mutants; proteins encoded by DNA that hybridizes to any one of the nucleic acid sequences of the invention under high stringency conditions or, less preferably, under low stringency conditions (e.g., washing at 2×SSC at 40° C. with a probe length of at least 40 nucleotides); and proteins specifically bound by antisera of the invention.

The invention further includes analogs of any naturally-occurring polypeptide of the invention. Analogs can differ from the naturally-occurring the polypeptide of the invention by amino acid sequence differences, by post-translational modifications, or by both. Analogs of the invention will generally exhibit at least 85%, more preferably 90%, and most preferably 95% or even 99% identity with all or part of a naturally-occurring amino acid sequence of the invention. The length of sequence comparison is at least 15 amino acid residues, preferably at least 25 amino acid residues, and more preferably more than 35 amino acid residues. Again, in an exemplary approach to determining the degree of identity, a BLAST program may be used., with a probability score between $e^{-3}$ and $e^{-100}$ indicating a closely related sequence. Modifications include in vivo and in vitro chemical derivatization of polypeptides, e.g., acetylation, carboxylation, phosphorylation, or glycosylation; such modifications may occur during polypeptide synthesis or processing or following treatment with isolated modifying enzymes. Analogs can also differ from the naturally-occurring polypeptides of the invention by alterations in primary sequence. These include genetic variants, both natural and induced (for example, resulting from random mutagenesis by irradiation or exposure to ethanemethylsulfate or by site-specific mutagenesis as described in Sambrook, Fritsch and Maniatis, *Molecular Cloning: A Laboratory Manual* (2d ed.), CSH Press, 1989, or Ausubel et al., supra). Also included are cyclized peptides, molecules, and analogs which contain residues other than L-amino acids, e.g., D-amino acids or non-naturally occurring or synthetic amino acids, e.g., β or γ amino acids.

In addition to fiull-length polypeptides, the invention also includes fragments of any one of the polypeptides of the invention. As used herein, the term "fragment," means at least 5, preferably at least 20 contiguous amino acids, preferably at least 30 contiguous amino acids, more preferably at least 50 contiguous amino acids, and most preferably at least 60 to 80 or more contiguous amino acids. Fragments of the invention can be generated by methods known to those skilled in the art or may result from normal protein processing (e.g., removal of amino acids from the nascent polypeptide that are not required for biological activity or removal of amino acids by alternative RNA splicing or alternative protein processing events).

Furthermore, the invention includes nucleotide sequences that facilitate specific detection of any of the nucleic acid sequences of the invention. Thus, for example, nucleic acid sequences described herein or fragments thereof may be used as probes to hybridize to nucleotide sequences by standard hybridization techniques under conventional conditions. Sequences that hybridize to a nucleic acid sequence coding sequence or its complement are considered useful in the invention. Sequences that hybridize to a coding sequence of a nucleic acid sequence of the invention or its complement and that encode a polypeptide of the invention are also considered useful in the invention. As used herein, the term "fragment," as applied to nucleic acid sequences, means at least contiguous nucleotides, preferably at least 10 contiguous nucleotides, more preferably at least 20 to 30 contiguous nucleotides, and most preferably at least 40 to 80 or more contiguous nucleotides. Fragments of nucleic acid sequences can be generated by methods known to those skilled in the art.

The invention further provides a method for inducing an immunological response in an individual, particularly a human, which includes inoculating the individual with, for example, any of the polypeptides (or a fragment or analog thereof or fusion protein) of the invention to produce an antibody and/or a T cell immune response to protect the individual from infection, especially bacterial infection (e.g., a *Pseudomonas aeruginosa* infection). The invention further includes a method of inducing an immunological response in an individual which includes delivering to the individual a nucleic acid vector to direct the expression of a polypeptide described herein (or a fragment or fusion thereof) in order to induce an immunological response.

The invention also includes vaccine compositions including the polypeptides or nucleic acid sequences of the invention. For example, the polypeptides of the invention may be used as an antigen for vaccination of a host to produce specific antibodies which protect against invasion of bacteria, for example, by blocking the production of phenazines. The invention therefore includes a vaccine formulation which includes an immunogenic recombinant polypeptide of the invention together with a suitable carrier.

The invention further provides compositions (e.g., nucleotide sequence probes), polypeptides, antibodies, and methods for the diagnosis of a pathogenic condition.

All publications and patent applications mentioned in this specification are herein incorporated by reference to the same extent as if each independent publication or patent application was specifically and individually indicated to be incorporated by reference.

Other embodiments are within the scope of the claims.

SEQUENCE LISTING (437 sequences)

SEQ ID NO: 1 - DNA, 42235 bp, Pseudomonas aeruginosa
  variation (1)...(42235): N is any nucleic acid.
atcgccgatccaatgccaaggagtacctgggcaatcagagcctactcacggctgccggggccggcattgccaagctcctggacgccgacgagaacaacaccagtaccgtcttcagcggcaacggcaccagcttcgggacgaccggaaccaacagcaactcggccctcaacagcatcctctccggcggcgtcagcgacatccggcagtggatgaacaagttgtacggggaggccttcgccgccgtctacgtgcagccaggtgcgcgggtcgcagtgcatctcgatcagcaactggcgatcgactatgaactcaagggccgcaaggtcgattacagctctggagccgctcatgcaacagcagacttggactaacccccttcttcgtctctgcgccggcctggcctgcgcgctgaccctggcagcgtgctccaccagcaaggaggagatgctgccccacggcgaggccaacatgctcgacgtctgggagcgaggtgcgaccagctcgataggcaacagccgtggccggctgctcctcgatgccaggcaaacgctgcggcgcccaatcgatccgcagcaggatgcctccgcgaatgaccaggccgactacacccgcacggccagcaacgagatccacagtcagttcaaacgactgcccaatcccgacctggtgatgtatgtgttcccgcacctggccggcagcgatcccgccccggtaccgggctacaccaccgtgttccccttctaccagcgagtccagtacgccatgccgggcgaacgcacggaggactattgatgggcttttttcaaacccttctgcgcggtcgcacacagcctcagtcggtaccggcagacgctcccgaagattcaggagcgctggacgtagcggccgcggaagaagcgactgagcgctatctggcgcgactggccgccatgggtattcctctgcccaacaccgggagcaagaatggcgccacgcaggccgaagcgtcacgcctctacgatcacgacccatcgttcgtagacctgctgccctgggctgagtacctgcccgacgagcaagtgatgctcctggaggatgggcgttcgcgcgccgcattcttcgaactggtgcccttgggcaccgagggccgcgatcccaattggatgcagaacgcccgggacgcattgaaagaagccctgcagaactccttcgacgagcacgaaacctcaccctggattgtccagttctacgcccaggacgagatcagctgggacaatttccaggagcagttgaggcagtacgtccatcctcgagcgcgaggatcggccttcagcgagatgtacctggcgctcatgaagcatcacctggagggcatttcgaagccgggcggactgttcgtcgacaccgccgtcagcaagctgccctggcgaggacaacagcgccgcgtgcggatggtcgtctaccgccggatccgcaaggaggatgcgcagattcgcggacaggacccggcggcgtacctgaaatccatctgcgagcgtatccaaggcggcctggcgaacgccggcatcgtcgcttcgcgcatgggcggacaggagatcaggaactggttgatccgctggttcaacccgcacccggatcacctcggccaggccgaggcggacctacgtcgcttctacgaactggtatgccgtccggacgaaccgatcctgcaggatgaattgccactggccgacggcactgacttctcccagaacctgttctatcggcagcctgtttccgatgccacccagggcgtatggctcttcgatgccatgccgcaccgagtgattgtggtcgaccagttgaacaaagcgccgctgacaggccacttcaccggcgagacgctcaaaggcgatggcctcaacgccctgttcgatcgaatgcccgaggacacgctgctgtgcatcaccatggtcgtgacgccgcaggacatgctggaagggcatctgcagcagctctcgaaaaaggccgttggtgacacccaggcctcgatccacacccgcgaggacgtggccaccgttcgacgcctgatcggccgggagcacaagctctatcgcggagcgatcgctctgttcgtgcgcggccgcgaccatacccagttggaggaacgctgcatcaccctgagcaacgtactgctcggcgccggcctggtgccggtcgaaccgcagaacgaagtcggaccgctgaacagctacctgcgctggctcccctcaaacttcgatccaaacgagaagcgagccctggagtggtacacccagatgatgttcgctcagcacatcgccaacctgtcgcccatctgggggcgcaccaccggtaccggacaccctggcttcacgctgttcaaccgtggcggcgcgccgttgaccttcgacccgttcaacaagctggaccggcagatgaatgcccacggcttcatcttcgggccaactggctccggcaagtcggcgtccctgaccaacctcatctgccagatgctcgccatgtacctgccgcggatgttcgtcgcggaagcgggcaacagcttcggcctgctggccgacttagccaagcggtttggcctctcggtccaccgggtgcgcctcgccccgggctccggcgtcagcctggcgccgttcgcggacgccatcaagctggtcgagagccccgaccaagtgaaggtgctggacgccgaagacatcgaggcctcggactcggtccagggcagcaaggccgacctcgaggacgaccagcgagacatcctgggcgagatggagatcgtcgcccgcctcatgattaccggtggcgaagagaaggaagatgcgcgcctgacccgtgccgatcgcagcgccgtccgccaggcgatcctggcggcggccaggacctgcgccgccgcgaaccgcacggtactgacccaagacgtgcgcgatgcgctctacgaggcctccaggagcgatagcaccgcgccagaacgccgcgcgcggatcgccgaaatggcggaagccatgcagatgttctgcatgggcgccgacggcgagatgttcaatcgcgaaggcacgccctggcctgaggccgaccttaccgtggtggatttcgcaacgtacgcgcgcgaaggctacgccgcccagctcgggatcgcctacatctcgctgctgaacaccgtgaacaacatcgccgaacgcgaccagttcaagggccggccaatcgtcaagatcaccgatgaggggcacatcatcaccaagcacccgctgctgctgccctacgccatgaagatcaccaagatgtggcggaaactgggcgcctggttctggctcgccacccagaacatcgacgacatcccagcctccggggcgccgatgctgaacatgatcgagtggtggttgtgcctgaacatgccccccgacgaagtagagaagatatccaggttccgcgagctgtcgccggcgcagaagtcgatgatgctctcggcccgcaaggaaagcggcaagttcaccgagggcgtgctcctggccaagggcaaagaatacctcgtccgtgtggttcccccgagtctctacctggccctggccatgaccgaaaacgaagaaaagaaccagcgctacaacatcatgcaagccaccggctgcgacgagctcgaggcggccttgcaggtcgcagcggatctcgacaaggcgcgcggcctgccacccttccccattgttttcccagaccaaccggcagtggagtgccaggacgaatgagagttctgaattcgctgacccagaacctgatcgacaacctgacccagatcctgcagaaccccgaagaggatgccctgcagacgctaaggatatgcgctcctgtactgatagaggagctgcagcagattcaactgagggcagtcgatcgccgggatatcgtcccgcagataaagcagctcttggatgaatggctgcaacaacatccacagcctgatacggcccaacaggcgctcattgaggccgtggaccgcgcggagatcctacagcggaggcaagcgtgagactcttgaagggcggctgggcagccaaacgatttcaaggtcccgccctgccctgggcggggctgctgctggtcttgctggctgcatccgccgtaggggtagagcttctggtgaagggcctgccagccaaccacagcctctacggcgatgcgaaagcgcgctggacgatcaatgaatacgccgacctggagtgccccttctgcaaggtctacaccccgcggcttaagcgctgggtagacagccatccggacgtgaacctggtttggcgccatcttcccctgcagatgcatggcgaggcggcccgccaccaggctcgcctggtggagtgcgcggggatccaaggcggcgccaaagccttctggagcgctatcgatgcgatcttcgctcagtcggccggcaacgggggcgggctgcctggcggcacattggactttcctgaactggaccaggctcgactggagaaatgtgcgaaagacaacgaacttattgactcagatatcaagttggacatcgacattgcacggtcgaagggcattacagcgaccccgaccctcgtcatccgggacaaccagacgggacgaagcgtgaagcttgaaggcatggccgacgagaccacgttgctgtcggcgatagactggctagccaaggatctctagcgtcgcgccaagagactcttggctaagaaatcggcgaggattccaacatccctcttttggtcctccaggatgccctgcacttcacctggcagaacctcgacctcctccccatccacaatctttaccattctcttgtggccggagctggtgaggctaagcctcaactccattgccggccgagcattgatgtaaatgctctcgagcaagcgctccatgacttcgaccactccttaatatcagttagccagctacatacaggaattatgctacccaggacatgcaggcgtcacccctacttatgtacgtggcagcgttcgatcacggctcgaaaaaatacaccacctacgagttgatgatttcctgctgccctatcggaagtgatcctgtctgctgtctgtacctttctagaaccggtacagacccatgcctcttcatcactccccccctggccggcggccaccaacgctggccgttggcgtactactggtactgctgagcagcgcgagtcaggccgaaacctgggtcatcaccgacaaggctcatccggtctctgccaccggatcgtcgcgcgttctgtttctggacgcccaggaacacctcgaggagcaactgactgcggccttgccccaggatccacagcatgctcaagcggcgtttaagcgattgctacaaagccccgatgggcgccgcctgcaggcagagctggtcaaggcacaacaagacgtcgccgatgcgtggagtctcggtgtcgagaagatccctgccgtagtagtcgataggcagtacgtggtctacggcgaaccggatgtttcgcgcgctcttgagctaatcgccaaggccaggaggtcgcgctgatgaccagcctcaacctccgccgcctggcagcggcggccgccaccttcagcctctcgttcacggcctcggccgcgatcaacagcgctgccatcgtctcctccaccctttcccctcagtgcctcgaatacaaggtcgtcgggatctgttactggctgctctgcggcccgcatggctgcaaagtgaagacgtcggtcaaggtccgccactacgtgcctgacgcagtcgtctccagctacgcgaataccgggagcaacccctggaccgaggtatcggcgctgggtacaccgaatccactcgcccaggccggcaatgacgcgaccacaaactacaaggccgagaacagcatcggccgcttcaaggaagcggatgtgatcggccatcctggtggcgccacgttcagccggttcgccagcgcctctgggtacgtttgccctggcgccaccgtcccgctggtgccgtactttctcagcacactggacgccattggctggcggcatggaattcccgagcaggtgtaccccgaagcgttggtcccagggctgcgcgaggtgggtggaatcttctccggcgacatgtgggggaacctctatccgcgcagcggcttcctgcaccagaccgacgactacaagacggcagccgtcatcgcccagcgcgccggcgatatcaccacgcgaatcggccagctccacgtctacctccccatgcgcgcagcccccaaggacggctactggccggcgggcgagctgaaagagggcgatgcctcgaccgggaaatggcaggagctgaccccatccctgagcctcaactgcgcggtgtttcccaactctgggccgaagacgcaagccgtcgacggggagcacgcctgggcgctctggcgtccctactcctgctgccagcgcaaggggcagatgttcatctgcagtaccgacttccaataaggacacggagacgaatcatgcgaatgaacatcacctcggtcgcgctaatgtggctgctcgcagcgcaacttgcccaggccgacgacccgatcaacgtgtccaagaccggcacggtgctcagcgacgaggtcctctacagcattggcggcggcagtgcggtgagcatgggcagcgccggccagatggactcgatcggcgtcggcttcggctggaacaacgacatgatgtgcggaaacatgaacctgagcaccaccctggagaaccagctcaacggtgccacacagggtttccagaacatcatgggctcagtcatccagaacgcgaccggcgcggtcatgtcgctgccggcgttgatcatccagcgcgcgaaccctcagctctacaacctgatcaccaatggcatcctgcaggcgcggatcgactacgaccgctcgaaagggacttgcaaaacgatcgccgaaaagatggctgacatcgctggcgagcagaccggctgggggaaaatcgccgaaggccaagccctgggcgccacactggcctctgacgggaaagacgccgtatccgccctcgaagcagtggagaagaaaggcggcaacgatggcgtaacctgggttggtggagacaaggccggcggctccggccagaagcccattcgcatcgtcaacgacgtgacccgggcgggctacaacctgttgaccagccgctcggtgaatgattcgtcgagcgtgccttccgccacttgcaacaacggcctggtctgcaacacttggtcctccccccaggaggccgccgcattcgccacccgggtactgggggagcaacagcaacagacctgcgaaggctgccagaagacggtgacggctgctggcgtcggcctcaccccgctgatccaggagacctacgacaagaagctccagtcgctgcaggagctgctgtcgaagagcaaaccactgactgcagagaacctggctgcggccggcaccgatgctctgccaattacccgcggcgtcatcgaggcgctgcgcgacgagcgtgaccaggacgtcctggcgcgccgcctggcgtccgatgtctccctgatggacgtgctcagcaaggcactgctactgcagcgcctgatgttcgccggcgccaaggagcccaacgtcgccgccaacggcctggccacccaagccgtcgatcagcagaccagcctcctgcagcaggagatctccaatctcaagaccgaactggaactccgtcgcgagttggccagcaactcccccatgcgggtcatcgagcgcgggcaacaacgcgcctcagggtccagtggcgtgttcgagtcggcgcccgatgccgatcgcctcgatcgcctgcaggccccctctgccgccggcggcaagtcgggagggagaccgtgatggcagatacgctcaccacccgaaagcttctcggtcagctactggtcggagtgctgatcgtcatcggactggcagtggtcggtacgctgctcagtctcttcgccctgaaccacttcggtggcatccagggcctggaggcctggcggcaaagcaactactggagcttgttcgcctggcgggcgctgctgtactgcgccctggccatcgcctggttccggcagcgcaaggaactgagcgcgcatgagcggcagcgcattcggcggatcgagatcctggtgctgttgctggtcctgctcatcgaattcagcaaagcctacttccgcacgggaggcgcagcatgaccttcatgaccaatgactacctggagtattacctcaccctcctcggctggatcatcaacaacgggatctggaacatgatctcggatactggcctgttcgcggtgccgttcgcggccatcgtgatgcgcgaatggctgaaagttcgtggggaaggcgccgacgagggcaacaagggagtgctgtctctcgcccgcatcgagacgcatatctacgtcggctacatcgtggtcgccctggcggggatcccggtcgtcaacgtgagcttcgacaccatcgagttcgaccagactcgcgcccagcagtgccaatacaatctgccggcaccggcggacaccggctggtcgagctccttcagcagcctggccggcaagagtgcgcagatgccgctctggtgggcgatgatgcacgccctgtccaagggcttcaccagcggcgccatcgcggccattccgtgcggcacggatctgcggcagatgcgaatggaagtggacaacacgcgcgtgaacaatccgctgctggcacaagaaatcgctgatttttccagagactgctacgggccttcccgtgcgcggctgttcatgcggcaacccgacctgggctccgtcgccgaggacaacaaggcgttgcaagacctgaactggatcggctcccgattcttgttgaacaccccggggtactacgacaccgactactcgaagagtccccgtcagtcgtggccctacaacgccacccgcgatgccggcctgcctcaggtgggcggtggtggcggctacccaacctgcaagcagtggtgggctgactcagggatcggcttgcgtgatcggatcaaggaccaggtggatccggacctgatgaccagcttcctcaagtgggcgaaatggttgaaccaggacgaggtgaccgaggctgtcattcgccaggtgatctcaccctccagccaggtcaagggtaacgtctacaccgattacggcgggcaggtgggcggcaccgtgtggaacggcatcgcgagaaccgcaggaaccttcggcgttgcggtgggcagcttggcatacttcccggcgatggatatggtccgccaggcactgccgatggtgatgtcgttcctgaagatggcaatggtcatctgcattccgatggtcctggtcatcggcacctatcaactgaaagttgccatgacgatgacggtcgtcttctttgcgatgatgttcgtcgacttctggtttcagttagccagatatatcgacagcacgatacttgatgctttctatggttcgggatcaccacatctttcattcaacccagtcatggggctgaatacggctactcaagatgcgatcttgaacttcgttatgggttctatgttcattgttttaccactactgtggatgacagcgatcggctggtccggaattcaagcagggtctgttctgaacggattgagcagagggactgaaggagttcaagccgccggcaaggaagcaggaaatagagttaaaaacgcagtttgaggaagtataaagccattaccgggctctagtcccggtaatggtgtgctgcctgatagtcaaacagctctgctacagattcagtttcagcttgtgaagtcatagttgagacatctcgacttggagaccctttagagacggagatgtcccctttaaccaaggcaaatcccaccagaaagacacacagtagagtcattgataccccagcaagccacataaaattctgtgacactacaagagctactaacaagaataggctaactcgcttaacccaacgtagagctggacggcgatcatgcaggcagaaacgcacaagcatacccagaccaaaaccgatccgggaggcaaagcctttgttggtgtgcgcgttcatcatcaatctcctggctcccaaagggaggcatcctgctatcacctatacgccgaaaaagatgatttggcaagcattatggcatattatgccactagctatctgccgactggagtacctcatggcaacgcgaaacgtcgtccttcccgatccgctggagcaggatatcaacgagctggtggagaccggccgctatcagaatcgcagcgaagtcatccgggcaggcttgcgcctgctgctgcaacaggaagcccagatangcgccaagctcgaaaccctccgcaacgcaacatccagtgggctgatgcaactggagcgcggcgagtacgacgagatcaccagcgacgaactggcccaatacctcgacgagctcggcaaccaggcgagccactgaagcatggccaagtaccgcatctctcatgatgcccaagcggacatcgtcgatatcctgcgcttcacccacaaccacttcggcgatgccgcgcgccgacgttaccaggcactcataggggcggcgctggaagcagttgcgacagacccacaacaggtaggcagcatcagccgtgaagaactgggagctggcctgcgcagcatccacctcgtttactgccactcgatgcccaatgtcggtaaggttgttcggcccaggcacttcgtcttctaccgggtggcgacagaccaggtgctagaggtggttcgcgtgcttcacgacgccatggatgtggatcaacacctgccccaacgatgagcaactgtaacaggagcaaatggcccaaaggggaaatgggcttgaagggcgaagggaatggttcacaagggtaaaagccctacccgaaagggcctgccggaaggcagaaagggctgcgttcgcgccggcgaacacgaaaaggctacgggtgaacatccaccagcaggtgccccatggttgatgcgcaatagcagtggcttgaccactcgattgcattccccctgaccaagcatttgcattcgtgctgaccaccgcttgcatgcggctttaccagtcacaccgtagtcacgaccggctgcagtcgacccaaagcggacctttgtgacagaccgaaatcggccaaaagcagacgctcaaaagcatctacgaaagcagggacaattccgggggatactcctctacgtacgttgcttatatcgcggaggaattggctgaaccgcggtgcggagagatctcctcaaactgatgggttgcacgcatatcgaagcagattacataggaggcttgcgctgttcaacagctcctgaggggacttgggttgcccatggtttccacggcccaatcgttgacgtcattgacgattccgctggctttttcagtacgcatcgcttggcgctccattacccagcccaatgcggccttgccgttgaccaagcgattccaaggactgcgatccatgtagccagccctctaatgcatgtatgtataggtaaggtcgtcgttatttcggcgtggatgtgctgactggaggtttagcgtggtgagtcagtatgtcgtgcgctatataagtctcatctcggcatccgcacatggatgctgttagattcagcaagtgggaaaaagcgcgagcgctaaaaggaaagctgccggccggcgtgctcagtagcaagctaccccggcaacacttaggaagaggtgatcatgaagttacaggcatatcggctgcagaactaccgccggctgcgcgatgttgtcatcgagctcgatgacgaaatttctatctttgtcggtgccaacaacagcgggaagacatccgccgtccaaggcctgtactcaatgcttcgcggcgaagtgaagaagttcgagctctttgacttcagtgcggcgctgtgggccgagatcgatgcggtcggcaggacgccccctggcgatgaggatgcgcccaaaaggttaccgtccatactcttggatctctggttccgcgtcggtgaagacgacctcgccactgcgatgtcgctgctgccgagcactgagtgggacggcaagtgcgtcgggatccgggtagcgttcgagcctcgggatgcccacgagctcgtctggaagttccatgaactacatgagaaggccaacaacgcagctgtcgcgcttgcggccaagcgcaaggccgccggggagcaagctgtggaggcgggcgcggaagacgcggctgcggtggtggccgatgccggcgagtacaagccttggccagaaagcctgacgaagtacctcacaaaggaactgagcaaggaatacaccttccgctactacgtgctcgatgagcgggcttttgtcggctatcaggcaagggaggccgactacgagccgctacccctaggcaaggagccgggcggtgcagccattctcaagtcgctggtgagggtcgacttcctgcgcgcgcagcggcacctcgatgacccagatgccggtagctctgatcgcgcagagagcttgtcgcggcgtctgagcaggttctatcaccgcaacctggagaagcgtggcgacgaccatgcggctctcaaggcgctagatacctcggagaaggagctgaacttccacctgaaggaagtcttcaatgacaccctcacgcgcctggccaagctcggctatccgggcgtcaacaatccggagatcgtgattcgggcggccttggatccgaccactgtcttggggcaagacgccaaggttcactacgtgatcccgggcgtagcttccgcccaactgccagacagctacaatggcctggggttcaagaatctggtctacatggtggttgagctgctcgacttgcacgagcagtggaaagccgaggatgacaagcgagctccgcttcatttggtcttcattgaggagcctgaggcgcatctgcacgcgcagatccagcaggtcttcatcaggaacgttttgcgcctccttgaggatgctaacgatcacgcgactttgttccacacgcagctcgtcatcaccacgcactccccgcacatcctctatgaacgcggattctcgcccattcggtacttccgccgcgtcaacgaccagttgggccatcacacggatgtgcgcaatctgtcgctattcaaaacgggcgcgtccgacgctccagcgcgcgaattcctgcagcggtatctgaagctgacgcactgcgatctctttttttccgacgcggtgatattggtggaaggcaacgtcgagcgtctgctcctgcctgcaatgatcgagttggtggccaagcgcctgcgttcttccgccctaaccatccttgaagtcggtggtgcgttcgcgcatcggttccaggagctgatcgccttcgttgggctcacaacactggtcatcacggatctggacagcgtgacggtcaagacggacgccgagaaggccgccgcgcaaggcgcaggcgctgagggcgccgttgacggagatgacgaggacgaggacgacgacctgaagcccttcgagcttgaagacgacgacgaagcagaaccgagtggcaagaagaagtccaagaagcgtggcagcacctgccatgcacacgtggaaggtgccgtcacgtccaaccaaaccctcatcagctggatcccgaagaagcggtcgatggcagagctctgggaagtcacggcggagcaaaagacgctgtcgctggctgaggattccagcgctggggttcgggtagcttaccagaccaaggtttcggtgacggtgggtgcgacgacatcacagctctgcggccgcacacttgaggaggcctttggtcttgagaacgcggactggtgccaggctgaggcaaaccggtcggtcggcctcaagctcaagcgcgcaccgagcagccctgaagagctggctgagaagttacacgatagggtggtcggcaagaacttcgacaagacccgctttgcgctggaggtactcgcaagcgggccgctcaatggctggaaggttcccgcgtacatcgccgagggcttggcctggctcgaagccaaagtggcccacgagcttgaggcggatgctgccatcgccaccgaggtcgcgactattgagccgactacagccgatgttgtcgctatcattgttgacccggggcagacggcatgagcagacgaattgatagcccagataccgacgccgaccgcgagatccacgcatgcattgtagcgacgcctccgcagcccttcgtggttcgtgctggcgcaggttccggcaagaccacctccctcatcaaggcgctggactgggtgatctcggagcacggcgccagcatgcgggcgaggaagcagatagtcgcgtgcatcacgtataccgaccttgccaccaatgaaatcctggcggacgtcaacgatgacccgctggttcatgtctcgaccatccacagcttttactggtctattgcaaagacgttccaggccgacatcaaggtttggctgcagaacgacatccgcaggcggatctccgaacttgaagaagagttcgagaattacagctcgcgtgtccggcagaccacgcgcgacaggaacaaggccgaccaagagcgatatgtccgaagcctggaggctgtggccggcgtcaggacgttcaactacggcgtgggcagtgactacgccaagggcatacttggccacgaggacatccttcagctcgccgacttcctgctacaaaaccgcccgctgttccgacgggtcgtggcgctgagctacccgttcgtgtttatcgatgagagtcaggacacgttcccgggtgtagtgaagtctttcaaggaagtggaagcccagatgcagggcaagttctgccttggttttttcggcgacccgatgcagtcgatcttcatgagaggcgcaggggacatccagcttgaggatcattggcgggccatcacgaagccggagaactttcgctgcgccaagcagatccttgacgtcgccaatgccgtgcgcgcgcagggcgatggcatggagcaagtccgcgggctgcacgagagggtcgatgggaacctcaagctggtggaggggtcggcccggatgttcgtcttgccgaacacgctgaaccgaaccgaggctttggcaagagtccgagcgtggagctcggcgacgaacaacgacgagggttggacaaccccagacatcgcagtcaagattcttgtcatcgtgcaccgcatggccgcaaaccggcttggcttcggcggcatctactcggcgctgaacgacaagacgtcggatgccatgaagcaagggatgcaggacggcaccggttggcccgttcgacccttcctaagttttgcgctaccgatcgttgcagctgtgaaggccggcaatgagttcgcggcgatgagcctgctccgggaattcagcccgcgcctggcgcctgcggctctgaccggccgacgtgccgcggatgtattgcgagagctgcacgctgctgcgtcgaggcttgtcgccatgctggacgaggcagggaccaccattggtgacatagctctccatctctgtgacacgggtctttttgagttcgacgagcgctatgcgcgtgttcttgggtttgtcagggatattgctgacaccgctcaggagcccgaggctgctgatgcagttccggccgaaggattatccttggacgcgacaatggccaagttcttcaattgctctgcgcaagagctttggccctatgaacgctatgtctcagaaggctccccctatgccacgcagcacggcgtgaagggagcgcagttcgaacgcgtcatggtggtgatggacgaggaagaaagcgactaccgaacgtacaactacgagcgtgtcttcgcgagtgctgaggcccgcgctgcagatcgtgcacgagcactagacggtgatgaaaacacttggagccgaacgctgcgactgctttacgtctgctgcactcgtgcccagcgggggctggtactagcgttctttgtcgccgaccctgcgaccaccctggaaaacgtcgtggcgagcgggatcttgccgcgaagcgcagtctttacgcaggaagtgttagttggatggccatagacgaacgattgcctgacctatttgaagccagagccgagcggcaggctcggtagctagcgggtggtaactctgaggacgtaatcgactgcaattggccgatttctgcctatgacgaggggcagctaccgacccattgctatccttcgtaagggtggctacgcaccgggcacgctgcgggatcggctgaagctaaaaaatcgcacaacagctttgtaaaacaagatctcggtcgataacatctatgaacggtctgggttggcaatcagtattggctgccagttcttgtgacgatgcatggtttaaatcgactctttgaggaaatgcgtgggaagcctggaaaagtgctgtttcgcctgcaaagaaataattcatgttcatgcgattcgttgtcggcagtgcggcgagtcccaaggctggcgaaggttcatgagctctccaacctcagtagttgcgttggtccttagccttttatcaatcgctgccacaaaacctgtggagcgattgttcgatgcccagcgagcagagctacaaatctccatcacgggtggtgattacaaagctgcccagcttatgttgaccaataacgggtcaaagcctgcaactttagtttccttcgaaatcacatcgaaagccacgaccaatacgaaaacatggtttttggtaagcaatacggatggcgaaattctggagccaggcaaaacttacaaaatcagggcctcaaccgatgagtctatcccaaaaattgtcgaagctgagcgtcggacgattttgaagtctcagtacgcacttgcagataattgcgaattaaccgctaaatacatagaggccacggggcagaaggttgtgcgtgtgcaaccgttcatgtgcgacacacctcctgaaaagggtggcctgccccctggtaaacctggcatacccatttggtaccttggtcaagaatgatgtttttatgccgccctgggctttgacgccgattaagcaaagctgtgttcgctcatccaatacgtccctcgcccagttaaacgactgttatgtatatgggtgctgccgctacgtaataccttggccctacgcatacgaagttaattctgaaagcgttcaatggacaatcttcctcctcggcgtcgactgcagcggtaaggtgatctactttcgaaacactgcaagggtaggtccttttttggcagcgtccatataccgaccgtggtatggctcagatgcgctggtactgcatttcaccaaataaagttgtgctatatcgctcacggccggtatttctatcgtccaaggcgacatattgacgatttcaagggttacgtacccgtcgaaccccggctctacctgaccgtcattacaggttacctgcacgaacaatcgcgcaagggttcctttggtttgcaccagaccaaaataatctaacggtattttgtatcgatgtttactgcaggtgatgacttgctcaccggatttcagcaccaaattttgctgaatttcttttggttccaaaaaaaacgtcgacggggctggatgcgacccatatacaatgcttgcagaggcgggcaaagattttggctcgtaatatgtatgccccaattgaatcttgagagaaaactcgtcaaataaagttttttcacatatagcgcattgcgcaacaagatgttctagatttttgtcaatgacaatcattttggcttaacttcgttcggcgatggctgagcgttttgttgtgactgaggaggctgcgactggtgttccagcacaaccttgtaatagacggcgtacattataagagaagacaccagggaacttccgattaaattcagcgtccacccgacccatatggtgggattgagcgaaaaccacttcttcaatcgcgcgcgccgcgtgatgggaagcgtcgatatttcactgccacgcttgatggggctttgggtgtgcgtcgattctgtggagaaaaaaatcacagagccaagcttctcgcctttggtaaggcagacatttttgttggtggtgttgaatatcctgagcttgagcttgccatcaaatgcaggttcgaccttcgccgaagcaaccagcacgccgcgtgagagaaaaagacttcccgtaggtaggactatgccgtaccgattgtgcggcaccttgatttcttcagcggcctccaccacaacagaatcgtgacccctgatcgtcataccatcgacaatgcgccacaggtttttgtcgttgccagaatagttatcactccacccttcacccacggacaattcgagggaaaactcttcaattctctcgtcccctgcatcagtgagtataaggctgttgctggagtacgatgccgcgtcaaaatccgtgtgggatttcgttgtacgccctttgatctgtaacacactcatcagatttgtccttcgtccttgggctgcgagacgcggccaccctgccattgtcctttataccggccgatatccccggataccgcctgaaagatgacgtgcgcaaagcgtgcaccaatctgaatttcaaacgcctcgctgtgattgttggtgagcgcgaacgtcatcggccctacataacctggaggcagcacactggaactgaacgttatcccgcttctgaacagcgtgcttctcggaaaaaaaagcgccgccagatcttccggcagatcgaattcttccatggtgctcgccagataagtcttgcccggttccatgacgaagcagtcatccgggtctgcgagcacgacctcgctggcaggggtgcgtcgcgtagattctcgcaagcttccaccccctactgtcaggcgagagaggcctgcgagtctgaggtcaaatccaacgccttccggggtggtcaactcacggtgggcaaggtgcttgattagttttccatcccggaccagtttcaggagcgagtgcggtgagtaaatcatctattttgcctcgggaagggctcagtctatagcactgagcaaccgcctacgtttacaggcaaaaagtcggactcagtcgttgtggccgcattttgcgtgtcctgcgggtttagtagcaaggacaaaaccgtgcgacatgcgcagcgcactttcactgcacggacagccccatcggcatagcaagccttcaccgccactctgattgggctcacgtccgacaagagtcgagcagctttgcaggattttccacatcaccaaaactgccaatggcagctaatggccgttctctgcctgtcgcctctttggcatgactggtcaagtcggatgcaaacggtggtcagcaccaatgcaattgggtggtcatgtgcgatgcaattacgcagttgagcctggcccagttcctcccaagcaaagcataagaccaagatggcacattgccaacaaaatacccttccccgctaccgttgttttatcgttgttgccagccctgatctggcggaaaagcccgctccatgaatcgtcatggagcctcccatgtttcaactcctttcctggatatccaggaagccgtcccccaccccaacaaccaaagctgccccagggggattcatccttcctctgagcagcatggaactgctcggcacgcctcgccgccggcagctactggagaacatctggcagcgcgcctcgctatccaagcagcaattcgaggagatctaccggcggccactggccaactatgccgagctggtccagcagctccctgcttcggaaaatcatcaccatgcccatccaggcgggatgatcgatcacggcctggagatcgtggcctacgcactcaaggtacggcagacctacctgctcccgatcggcgcagcgccggagtcacagtcagcccaggctgaagcctggtcggccgccgcggcgtatggcgccctggctcatgacataggcaagatcgtcgtcgacctgcaggttgagctacaggacggcagcacctggcacccttggaacggaccgatcaaccagccataccgcttcaagtacgtgaagtcccgcgaataccagctccacggcgctgcctcagcacttctcatccaccaactgctaccgcgcactgcactcgattggctcagtcgctttccagagctgtgggctcaattgatctacctgttcgctgggcagtacgagcacgccgggatcctcggcgagatcatcgtgaaggcagaccaggcctcagttgcacaggagctaggaggcaatccggatcgagctctggctgcaccgaagcagtcgctgcagcggcagttggcagacggccttcgcttcttggtgaaggacaagttcaagttgaatcaacctagcggcccgtctgatggatggctgacccaggacgcactctggctggtgagcaagcctgctgccgatcaactgagagcctacctgctggcccagggtatcgatggggtgccctcctctaacgcgccgttcttcagcatgctccaggaccaagccgtcatccagacaaatgccgaggacaaggccatttggacggccacggtagacaacggtgctggatggagaaacaagttcacgctactcaagattgctccagccttgatctggacagatgctgccgagcgcccctcaccctacagcggatcactggtcgttgaagatggaaccgcctcaacggaaaagccggaaacgacctgtgaaattcccaacgggccggctgaacagcagcaagcaccagaaacgaagatgatgctccatcaacctgcgccgagcgttgcgaaaccggcaaacgagacgcaggcgattgcgaaaccctcaactgatgatcaagaagaaacagacgatttgtatgcacttcttggtaatatcaattcgccactagaagagctagacactagccacgactcgccggctgcctctcctacgaacacacgcggggaggagaacctacagcagccactagggaccaaggagccaacagattgcgctcctgaagcaattgaagatgtatttatgcctagcagaagtactgatctgggacagggattcgttggttggatgaaatctggcatcgcggcccgtcgcctgttcatcaacgacaccaaggctttggtgcataccgtagacgggaccgccatgctggtcacgccaggaattttcaagcgctatgtccaagagcatccggtgcttgaaaaactggcccaagccaaggagacgaccggctggaagctggtgcagcgcgcgttcgaaaaacaggggcttcatcggaagaccagtaaaaacctgaacatctggaccatcaaggtttctggtcctcgcaagacgaaagagctcaaggcctacctgctccaggatcccaaattgctgttccctgagcagcctctggacaacccaagcctcacggtcatcaccgatgccgaaggaggtgtggaatgacgccgcagcagctcaccgaggagtacatcttcgcgcacgatctccgggaagccagcgcgaagatctaccgcgccgcgaccaaggcgctgctcaagcacttcggtcctacggcaaccgtacaggacgtggaccaccgggctgtcctgggatggcgacgcaaggtactggaacaaggcctgtccaagcggagctggaacacgtactcgaatcatctgcggacgatctggggctatgccatcgagcatgagttggtgacgcactcccaagtcaacccgttcagaaagaccaccgtcattccccccaggcgagcaagcaaaaccgtcgccgccgaagccatcctgctcgcccgcaattggctcaacatgcaggacggcgcagagcgctgcaccggcgaacgcgcacggatcacgcccgcctggttctggctttgcacgtttgaggtcttctacttcaccggcatccggttgaatgcgctgttgtgcatccgcaagcgcgacatcgactgggaaaatcaactgatcctcatccgcggcgagacagagaagactcacaaagagttcgtagtgccaataacggaggggcttgtgcctcacctatcgaggctcctgcaagaggccgatagagccggattcgccgatgacgaccagttgttcaacgtcaaccggttctcaccgcactacaagagcaaggtgatgaactccgaccaggtcgaagccatgtaccggaagttgaccgagaaggttggggtgcggatgaccccgcaccgtttccggcacaccctggccaccgacttgatgaaggcacccgagcggaacattcacctcacgaagtgcctgctcaaccactcgaatatccagaccacgatgagctacatcgaggccgactacgatcacatgcgtgccgtgctgcatgctagaagcctggcccaaggcgcgctggagaatgtcaggaaggtggattacagcggctccccgcaagcctctgccaaaccgaagccatgcgggcaacctctcgctcgagtgagtgaagcgccgccaccggaggccaggacagagcctgcagaaccaagggagcacacgccagggacaggcattcagggaggtccaaccgcgtgggaagcagatgcgctaccacagccacctgacaccttcgaaccaagcgtgctgttcactctgatggctcaaaacttatcgaaccgtgccgcctcggcatccgcggctcccgctgcaacaagcggatcaggcggatggggatctgccgcccgaagcaatctcgcctagcgataccggtactgagggccggctaccggacgaaaggtagccgtgccttccagcagatcgttaggcctgtaggaaaaatctggaattaccgagagcgcctggattccagcgccggcatgctggcagagccagcgcaatttcaaggccaataccacagtaccctctgtaatcgctgattacgtcgggggcgcattgctacgcctgcagaatggtttcagggccttagaaacagaaaagcccacctagaaaggcgggctattccatattgacatcacgtcaatgcgggcctaatgttcggcccagacggctgctagacaagaaccggcgtaacaccccttcctagcctatgcaactcgccccgtagaaaatggtgggtcgtgtaggattcgaacctacgaccaattggttaaaagccaactgctctaccgactgagctaacgacccaagtatgaggtggtcggggtagagagattcgaactcccgacatcctgctcccaaagcaggcgcgctaccggactgcgctataccccgattggaatttggctccgcgacctggactcgaaccagggacccaatgattaacagtcatttgctctaccgactgagctatcgcggaacgtctttcttccaaccctggacgcttccggtgttgctggattcgcgtctcagaggcgcgccattttacggatgcgcgcgggcatgtcaaccctctgatccaaaaagtttttcttctttttccacgagcgacaaaacggcccttccactgcatgcggcagcgctctcgcgcctaccggacgcccatgaaaaagccccgccgaagcggggctttccctgtccgcccccgaagaggtcaggcgaagacgatctcgtcgccttccaccttcgccgagatactggcacccggcgcgaatttgccggccaggatcagttgcgccagcgggttctcgatccagcgctggatggcccgcttcagcgggcgtgcgccatagaccgggtcgaagccgacggcaatcagcttgtccagcgcctcctggctcagttccaggctcagctcgcgctcggccaggcgcttgcgcaggcgaccgagctggatctcggcgatgccggcgatctgctcgcgagccagcggctcgaacaccaccacttcgtcgatccggttgatgaattccggacggaagtgcgcattgaccgcgtccatcactgcggcacgttgcgcctcgcggtcgccggccagctcctggatctgcgccgaaccgaggttggaggtcatcaccaccacggtgttgcggaagtccaccgtacgcccgtgactgtcggtcaggcgtccgtcctcgagcacctggaggagaatgttgaatacatccggatgggccttctccacctcgtccagcagcaccaccgagtagggcttgcggcggatcgcctcggtcaggtagccgccttcctcgaagccgacgtagcccggaggcgcgccgatcaggcgggccaccgagtgtttctccatgaactcggacatatctatccgcaccagcgcctcctcggtatcgaagaggaactcggccagcgccttgcacaactcggtcttgcccaccccggtcgggccgaggaagaggaacgagccgctcggccggttcggatcggcgaggccggcgcgcgaacggcgcacggcgttggacacggcgactaccgcctcgtcctggccgatcactcgccgatgcagctcctgctccatgcgcagcagcttctcgcgctcgccctcgagcatcttcgacaccgggataccggtccacttggaaaccacttcggcgatttcctcgtcggtcaccttgttgcgcagcaactggttctcggtcttgccgtgctggtcgaccatctgcaggctgcgttccaggtccgggatggtctggtactggatgcgcgccatgctctcgaggtcgcccttgcgccgcgccgcctccatctcctgcttggcctgctcgatcttctgctggatctgcgccgagccctgcacctcggccttctcggacttccagatctcctcgaggtcggcgtattcgcgctcgagcttgacgatatcctcctccagcttggccaggcgcttcctggtggcttcgtcgtcttccttcttcagcgcctcgcgctcgatcttcagctggatcaggcgacggtcgagacgatccagttcctccggcttggagtcgatctccatgcggatgcggctggcggcctcgtcgatcaggtcgatggccttgtccggcagttgccgatcggtgatgtagcggtgcgacagcttggccgcggcgatgatcgcgccgtcggtgatgctcaccccgtggtgcacttcatagcgttccttgaggccacggaggatggcgatggtgtcttcctcgctcggttcgtccaccagcaccttctggaagcggcgctccagcgcggcatccttctcgatgtactggcgatactcgtcgagggtagtagcaccgacgcagtgcagctcgccgcgcgccagagccggcttgagcatgttgccggcgtccatggcaccttccgccttgccggcgccgaccatggtgtgcagttcgtcgatgaacaggatgacccggccttcctgcttgcccagttcgttgaggaccgccttcaggcgttcctcgaactcgccgcggaacttggcaccggcgatcagcgcccccatgtccagggccagcaggcgcttgtccttgaggccgtccggcacttcgccgttgatgatgcgctgggccaggccctcgacgatggcggtcttgccgacgccgggttcgccgatcagcaccgggttgttcttggtccgccgctgcaggacctggatggtccggcggatctcgtcgtcgcgaccgatcaccgggtcgagcttgccttcctcggcgcgcttggtcatgtcgacggtgtacttgtccagcgcctggcgcgactcctcgacgttcgggtcgttcaccgcttcgccgccacgcaggttggccacggcattctccagcgccttgcgcgacacgccctggccgagcagcagcttgccgagcctggtgttctcgtccatcgcggccagcaataccagctcgctggagatgaactggtcgcccttctgctgggccaggcggtcagcctggttgagcaggcgtgcgagatcctgggacaggttcacgtcgccggtcgggctctggatcttcggcagcgcgtcgagttctttgttgaggccgctgcgcagggcggcgatatcgaagccgacctgcatcagcaggggcttgatcgaaccgccttgctgctcgagcagggcggaaagcaggtgcaccggctcgatggccggatggtcatggccaacggccagggactgggcgtcggagagcgccagttgcagcttgctggtcaaacggtctattcgcatgggtcgtccttccttctatagagcgggccggaacgatgggtgtccctgatgaagaaaagcccgccgagatgactcagtagataagggcgattttccgcggttcaagcgaccggaccgtgacatcggtcagttgccgccggataacctgcgcgggcctagtcctggagccagaccaggctggcaaaacggccggtacgcgacgagcggcggtaggaatagaagcgcgcggtatcgctgaaggtgcagaagccgccgccatgcacggcggtgacgccatgggcgcccaggcggatccgcgcgagtcggtagatgtcggccatgaagcggcccggattggcgctaggtacgaaagccgagcgcgcctcggcgtgcgcagcgacgaatgcatcgcggacctcgccgccgacctcgaaggcctgcgggccgatcgccggccccagccagaccagcagttcgtcgccgggcacgcccaggctgtccaccgtcgcctccagcacgcccgccgccagcccgcgccagccggcatgggccgcggccacccgggtgcccgagcggtcgcagaacaacgccggcaggcagtcggcggtcatgatcgtacaggcgacgcccggcatcgcgctccagctggcgtcggccctgagcaccggttcgggtcggcctccaccacgtcactccgtgcacctattccaaccagctcggccggcattccagacgctcggtcaggcgtcggcggttttattccacggcgcgcggatcgtcgtagacgtgggcgccaaggttcagactgtcgaagggtgcctggctgaccccgccactgcgcgtggtcacgcaggcccgcacacgggccggcgccggccagtcgggggtcagccaggcgttcaaccgacgaacgcctcgcgatcctggcgcaacaggctgagcagccagaggaattcttccggcagcggcgattcccacttcatgcgcacgccggtggccgggtgatccagttcgaggaagcgcgcgtgcagcgcctgccgggggaattcgcgaagagtctggaccagggtctggctggccaccgggggaatcctgaagcgcccaccgtagaccggatcgccgaccaggggatagccaatatggctcatgtgcacgcggatctggtgggtacgcccggtctccagcttgacccgggtatgggtgtgcgcacggaagcgttccagcacgcggtaatggctgaccgccaccttgccggcgtcgaccaccgccatcttctgccgctgcacgccatgccgtccgatcggcgcatcgatggtgccgccggaggtgatcacgccgatcacgatcgcctcgtagatgcggctgaccgaccgtgcctgcagttgcgccaccagcttggtgtgggcctccagcgtcttggccactaccatcaggccggtcgtgtccttgtccaggcggtggacgatcccggcgcgcggcacattggcgatgtccgggacatggtagagcaaggcattcagcagggtgccgtcctgatggccggcagccggatggaccaccaggccggcgggcttgtcaatcaccaggatgtgctcgtcctcgtagacgatttccagctcgatgtcctgtgcgagccactcgccctgggcttcctgctcggcctccaggaccagttgcgcgccgctgtggacgatgtcgcgcgggcgcagcacggcgccgtcgacggtcaggcgaccgtccttgatccagccggccagacgggagcgggagtgttcgggaaaaagctgggcggcgatctggtcgagacgctggccacccagctcgaacggcacctcggccgcgcgttgaatcatatcggacatgagtaggagacgatgctcagcgcggcttttggaatcggctacgcgctgtggttaaatacggggtctttgtcccagggggtgcctggggcgccaatcataacagacggttgaggccaagccgaccgtcccagggacgcaagccgccatgcaagtgaaacacctgctgctgatcgccatcctcgccctcaccgcagcctgctcctcgaacaaggagactgtcgacgagaacctgagcgagagccagctgtaccagcaggcgcaggacgacctcaacaacaagagctacaacagcgccgtcaccaagctgaaagccctcgaatcgcgctatcccttcggccgctacgccgagcaggcccagctcgagctgatctacgccaactacaagaacatggagcccgaagccgcccgcgccgccgccgaacgcttcatccgcctgcatccgcagcaccccaacgtcgactacgcctactacctcaaaggcctgtcctccttcgaccaggaccgcggcctgctggcgcgcttcctgccgctggacatgaccaagcgcgacccgggcgccgcccgcgactccttcaacgagttcgcccagctcaccagccgcttccccaacagccgctacgccccggacgccaaggcgcgcatggtgtacctgcgcaacctgctggcggcctacgaagtgcacgtcggccactactacctgaagcgccaggcctatgtcgccgccgccaaccgcggtcgctacgtggtggagaacttccaggaaaccccggccgtcggcgatggcctggcgatcatggtcgaagcctaccgtcgcctgggtctcgacgacctggccagcaccagcctggaaaccctcaagctgaactatccggataacgccagcctcaaggatggcgagttcgtcgcccgcgaaagcgaggccgacacccgctcctggctggccaaggccaccctgggcctgatcgaaggcggcgagccgccgccgcacatggaaacccaggccgccaaggacgtgatcaagcagtacgaggatgccgagcgggagatccccgccgaactgaagccggaaaaccaggatcacagcgccgacgacgagaagccggagagcgatgacgacgaggactccggtcgctcctggtggagctacatgaccttcggtctcttcgactgatcgcacgaaacaccgaagggaggcgcaggcctcccttctttttgcccgccgccatgcctctcccagcgccaaacgccgcacagcctggaccttcccgtctgggatcgagccggcggcttggctaaactgcagctttctccagcctccgagatcaccatgggccttttccgcctcctgttctggatcgccctgatcgccatcgcgttctggctctggcgtcgctttacccgtcccactccgcgccagcagcaacgtccgcaggacgagccgagcgcatcgccgatggtccgctgcgcccattgcggcgtccacgtgccgcaggccaacgccctcgcccacgaacaacgctggtattgcagccaggcgcacctgcgccaggaccagggcgaccgtgcgcgctgaacggctacggctgagcgaggagcaggggcaacgcatcctccgtctgtaccacctgtaccgcctgaccatcggcctggtactggtcctgctgatctccagcgaactggaagatcaggtcctcaagctcgtccaccctgaactgttccatgtcggcagttggtgctacctggtcttcaacatcctggtcgcgctgttcctgccgccgtcgcggcaattgctgccgatcttcatcctcgcgctcaccgacgtgctgatgctttgcggcctgttctacgcaggtggcggcgtacccagcggcatcggcagcctgctggtggtggcggtggccattgccaacatcctgctgcgcgggcgcatcggcctggtcatcgcggcggcggccagcctcggcctgctctacctgaccttcttcctcagcctgagcagtccggacgccaccaaccactacgtccaggccggcggcctcggcaccctgtgcttcgccgccgcgctggtgatccaggctctggtgcggcgccaggagcagaccgaaacgctggccgaagaacgcgccgagacggtcgccaacctggaggaactcaacgcattgatcctgcagcgcatgcgcaccggcatcctcgtggtcgatagccgtcaggccatcctcctcgccaaccaggccgccctcggcctgctcaggcaggacgacgtgcagggcgccagcctcggccgccacagcccgatgctgatgcactgcatgaagcaatggcgcctgaatcccagcctccgtccgccgacgctcaaggtggtgccggatggcccgacggtgcaacccagctttatcagcctcaaccgcgaagacgaccagcacgtgctgatcttcctcgaagacatttcgcagatcgcccagcaggcgcagcagatgaagctggccggtcttggccgcctgaccgccggcatcgcccatgagatccgcaacccgctgggcgcgatcagccacgccgcccaactgctgcaggagtcagaggaactggatgccccggaccgacgcctgacgcagatcatccaggaccagtcgaagcggatgaacctggtcatcgagaacgtcctgcagctctcccgtcgccgccaggccgaaccgcagcagctcgacctgaaggagtggcttcagcggttcgtcgacgaataccccggcaggctgcgcaacgacagccaactgcacctgcagctcggtgccggcgacatccagacccgcatggacccacaccagttgaaccaggtgctgagcaacctggtgcagaacggtcttcgctacagcgcccaggcgcacgggcgcggccaggtctggctgagcctcgcgcgcgacccggagagcgacctgccggtgctggaagtcatcgacgacggtcccggcgtaccggcggacaaactgaacaacctgttcgaacccttctttactacagaaagcaaaggcaccggcctgggcctctatctctcccgcgaactctgcgagagcaaccaggcacggatcgactaccgcaatcgcgaggaaggcggcggctgcttccgcatcaccttcgcccacccgcgcaaactcagctgacggaagccgcacgcatgagccgacaaaaagccctgatcgtcgacgatgaaccggatatccgcgaactgctggaaatcactctcggccgcatgaagctggacacccgcagcgcccgcaacgtcaaggaagccgcgagttgctggcccgcgagccgttcgacctgtgcctcaccgacatgcgcctgccggacggcagcggcctcgatctggtccagtacatccagcagcgccatccacagaccccggtggccatgatcaccgcgtacggcagcctggacaccgcgatccaggcgctcaaggccggtgccttcgacttcctcaccaaaccggtcgacctcggtcgcttgcgggagctggtggcaaccgccctacgcttgcgcaacccggaagccgaggaagcgccggtggacaaccgcctgctcggcgagtcgccgccgatgcgcgccctgcgcaaccagatcggcaagctggcgcgcagccaggcgccggtctacatcagtggcgagtccggcagcggcaaggaactggtggcgcgcctgatccacgagcaggggccacgtatcgagcggccgttcgtgccggtgaactgcggcgcgattccctccgagctgatggaaagcgagttcttcggccacaagaaaggcagcttcactggcgctatcgaagacaagcagggcctgttccaggccgccagcggtggcaccctgttcctcgacgaagtcgccgacctgccgatggccatgcaggtcaaactgctccgggcgatccaggaaaaggccgtgcgcgcggtcggcggccagcaggaggtcgccgtcgcacgtgcgcatcctctgcgccacccacaaggacctcgccgccgaagtcggcgccgggcgcttccgccaggacctctactaccgcctcaacgtcatcgagctgcgcgtacaccgctgcgcgaacgccgcgaggacatcccgctgctcgccgaacgcatcctcaagcgcctggccggcgacaccggcctgccggccgccaggctgaccggcgacgcacaggagaagctgaagaactaccgcttcccgggcaacgtccgcgagctggaaaacatgctggagcgcgcctataccctgtgcgaagacgaccagatccagcctcacgacctgcgcctggccgatgcgccgggtgccagccaggaaggcgccgcgagcctgagcgaaatcgacaacctcgaggactacctggaagacatcgagcgcaagctgatcatgcaggcactcgaggagacccgctggaaccgcaccgccgcggcccagcgcctgggcctgacgttccgctcgatgcgctaccgcctgaaaaagctgggcatcgactgaaagtgaaaaggcctgtccgaagacaggccttttggttttcgctcctcagaggcgaccagccggggcgtagggggccgggtcgatgatcggttcccgcccgctcatgagatccgccagcagacggcacgacgccggtgccaggaccagcccgttgcggtagtgcccggtattcagccagagcccgtcgaagccaggcaccggaccgatataggggatgccttcgggagagcccgggcgcaaccctgcccagtgggccaccggctgcatgtccgccagttccggcaacagttctgccgcagacgccctgaggctttccagcgcctcgtcggtcggcgtcttgtcgaagcccgaatgttccaaggtgctgccgatcaggatgtggccgtcgcgccgcggaatcgcgtagcgccccttggccagcaccatgcgcggcaggaaatccgccgcgcacttgtagaggatcatctgacctttcaccggtaccacgggcagttccaggccaagcggcttcaacaactcgccgctccaggcgcctgccgccagcagcaccttgtcgccacggatctcgccacgcgaggtcgccacgccgaccactcgatcgccgtcgcgcaaccagccgcgcacctccgtctgttcatgcaactcgagattggcgaattgttgcagggatgcccgcaatgagcgcgccaggcgaggattgcgcacattggccacgcccgacatgtagaccgcccgctggaagcctgcgcccagcccgggcaccgccgcgtaggcctcctcgatcggcacttccttcaacggccgggtgtggttgcgtgcccactgcagtgcctcggtctggtcgtccaggtccagccagtacaggccaacggtatggacctcgggatcgagcccggtctcgtcgagcaaacgctgccccagggccgggtagaagtcctgcgaccagtgcgccagggcggtcaccgccgggctgtagcgccacggatagagcggcgagacgatcccgcctcccgcccaggatgcctcacgcccactctcgccccgctccaccagggtcacccgcagtccggcgagcgccagctcccgggcggtcaacaggccgatgacgccagcgcctaccactactacatctctactcaccacagggctcctaccgatttgccaggaacagagaaatatcactcaaagggatcagatgctgacgaattgcctgcttcaacgaactcagtcgaatctagtcccggtgaaaagcccatcatacccgcagaggtattcatcccatgaaatcgagtggtttgaatttggtggaactatcgatagtcctatcgatccttgcgataggcgtgacaattgcgctgcccaccctccccgacagaatgaagcgggacattagccgtgatattggtgacagcctgactagtcatgtgatggctgcgcgggctagcagcatacagaacggcgtgatcatcgaggtgtgcggtagcggtgacggcagtacctgcagcgaggaatggcatctcggctggttcagccgtaacgacaggagccaacagatactggcccggcatgaaaatacgagtcgcaccgatattcattggcggggcttcgacaagcgactgcgctacctgcctaatggcaccagccctacaggtaacgggcgtttcttcgaatgtaaggacgatcgcatcgagtggcaattggtgctcaatcggcaaggccgcctcagggtggcgggaaagagcgaaaataaaaagctctcttacctgtgctccaggcggtgagagaactgtttcacataccgtttgccagtcatcccactctccgctccggctgtctctgctacagggacaatgcgctctccactaggcaagattatctggcccttttccttgtggagtactgcatgcgctctatttgtcgcagcgccggcttttccctgatcgagttgatgatggtgttggttctggtcgccatattcgccagcattgccgtacccagtttcaacgccttgatcgagcgcaaccgaatccagactgccagcgaggaactctacagcctgcttcagtacgctcgcagcgaagctgtaaaccgtcatgccaatgtgagcatcagggcgacgcagaacaatgactgggcaaaaggcctggaaatcatcagcggcgcgaccaccgtgcaaaagcaccaaggtttccagcaggtctcgctatccgccagcagtgcgactgcggagctgaccttcaacgctaccggcacacttagcaaccaggctgcaaacattgacataaaggtctgcttcgccggtgacaaaagtacaggacgtctgcttaccgttcagcccagtggacgcgtgatcctgtacccatcttcaaagcaaccggacagctgtaactgaggaaagcccatgtctcgagaaacgggtttcagcatgatcgaagtactggttgctctggtgctgatcagcattggcgtactgggcatggttgccatgcaagggcgcacgatccagtacacgcaggagtcggtacaacgcaatgccgcagcaatgcttgctagcgacctgatggaaataatgcgtgcggacccagatgccgtactcaatctacgcgcccaactacgcgaagactcggtctactacaaggccaagggcagcgactttcccgcagccccagcgcgctgcgcgccattgccagcagatgctaaggaacgtctcggctgctgggcccaacaggcctcgaaagacttgccgggagcctccgcactcttgaatagccaattctacatttgtcgcagcccaaccccgggtacctgcgacaacaccaaaggctcggccatcgaaatccaggttgcctggcgagccatggatggagcgtgtttcaacgcctctgactccaccttgtgcacctacagcgtccgctccgaattgtgagaacaagcatgctcttcagcaaaatgcagaaaggcctatcgatggtagaactgctcgtggcactcgctataagcagcttcctgatcctggggatcagccagatctacatcgacaacaaacgcaactatcttttccagcaaggccaggccggcaaccaggaaaatagccgcttcgttcttatgctgctgcagcaacaactggataagacagcctatcgtcgccttcacgacgacaacatggagaatgctttcaaatccgcgacattcaatggctgtcgtgcatttgtggctggcgagactatcgctgcggcaactgccctcaaggcgggtgagtacggtgtctgcttgcgctatcaacccgcctacaaaggggagcatgattgcctcggtaatgaaattaccggagttccggaaaagcccttcacaaatactccccctgtcgtcgttcgcctggtctacctaccgagcgccggtaccctgagttgcagtcgtcccgatatcgcccagtcgaaatcgggagaattggtcagtggtctcacagacttccgcttggaagcgggggtcgggccagcagatcgtagcgaacgcaaagtatccagcttcgtcgcactacaggatgtcgccggtcgtcctatccgagcattgcgcttctcaatcctggcaggcagcgacaatacaagcctgcgcacaggagatgatagccaggcacgcgatcgctggatcgtcctttatcccgagagcaaaagcgccatcgaggccgcagacaaaggccagatttaccaaatagcgcgtggtaaccaaaccatcaggaatctcatgccatgaccctgcgccatacctctcgacagcagggatccacgttgttgatctcgctggttatcttgttgatgatcacgctcctcgccgtttccaacatgcgcgaggtgtcactggaaagccgtatcaccggcaatctcatcgaacagaagcgcctgcgcaatgcgggcgaagctgggctacgcgaaggtgaacgacgctttttcaataccatcaagcccccagaggtcggcagcggatgcgccgatagcaatgtcaaacggccttgcatactgaacctgagtgccctctccgtaccccgagatgacgtgcacaacaatccggtggcagccctgaacggcaagacagataacgccaattcacgtgtctggatgccctaccgaggcagcgatctgaataaccctacgcagatcgacaaagaccgcgcagtcacctggcagaccatcacggtgcccgctggcgaacagaacaacgaagcggaaaatcccgagtacggcaacatgatgcgcggggtcggcacgttctactacgaaaccaacagccgcgccctcaacaaggcgggcggagagactgttctacaggccgttcatgcacgcctgtataccaactgactggagccagcgcatgatccaccagattacccgcgcaggaaaaagcctgctggctgcaggttgcaccctgagcatcctgttcgcctctgacagttatgccgccacggccctgaatgtcagccagcaacccctgttcctaacccagggcgttgctcccaacctgctgttcactctagatgactcaggcagtatggcctgggcttacgtgcccgacggtattagcgggaatagcggcagagcgggacgttccagcgattacaacgcactgtactacaaccccgattatgcttaccaagtgcccaagaaattgacactgtcaggcgatcagatcatcgtttccgactatccagtgccacgcttcacagcagcctggcaggatggctacgcccaaggctccaccaccaacctgagcaataactatcgccctcaatggggaaccggctggcttggttgcatcgatagcagctgcaataccgggagagcttattactatacttataaggtaagcgctagctgccctgcacagccggtgagcagctccaactcctgttatacctacaatgctcttcctaccagtcaggaaagcaactttgcgatatggtactcctactatcgcaaccgcatcctggccacaaagaccgctgccaacctggccttttacagcctgccggaaaacgtgcgtctcacttggggggccctgaacacctgtagcatcggcgccaacagcagaagctgccaaaacaatgccctgctccaattcaacaagcagcacaaaatcaatttcttcaattggctggcgaacagcccggccagcggcggtactcctctgcatgcggctcttgaccgagccggacgcttcttgcaaaccaacggcacagcttataccaccgaagacggaaagacatattcctgccgggccagctatcacatcatgatgaccgacggtatctggaacggtcggaacgtcacccccggcaatctcgacaaccagaaccagacctttcctgatagcaccctctataggccacagcccccttatgccgacagcaatgccagctcattggctgacctggctttcaaatactggaccacagacttacgtcccagcatcgacaatgacctgaagcctttcatggcctacaagagtggggacgattccaaggattactgggaccctcgcaacaacccagccacttggcaacacatggtcaactttaccgttggcctaggtctttcctattcgctcacattgaactctgcaccaacttggacaggcagcacctttggcaactacgaggagttgatggctggaagcaaggcttggcccagcgtcgataacgacgccgcacccggtaacgtctacgacctctggcatgcagctatcaactctcgtggagacttctttagcgcggaatcaccggactctctggttcaggctttcaataagatcctgacacggatttccgagcgcaacacctcctcctccaaaccagcaatgacttccgcgctgcaggatgacggaaccggcgacaagctgatccgctacagctaccagtccagctttgccagtgacaagaactgggcgggcgaccttatacgttacaaggtggagtcgacttccaccggttcgaccaaaacccaggaatggagcgccggcgcactgctggacaaccgagctcccgctacccgtaatatttacatcgccagcaatagcggaaccaaccgccttaagcctttcacatggagcaatattgagggaagtcagttagccacttggctgaaccgcaacccggacaaggacaatcaggccgacaccaaaggagcacagcgggtcgacttcatccgtggccagcagaatatggatggattccggcaacgacaggcggtgttaggggacatcgtgcactcgtctccagccgtggtcggaccggcccaatacctcacttatctggccaaccccatcgaacccagcggcgactacggcacattcaagacagaggcagaccagcgcagccctagagtttatgttggatccaacgatggcatgttgcatggtttcaacatcaaaaccggcgtggaagagttcgctttcatccctacagcagtattcgaaaagcttaacaagcttaccggcatcagctaccagggcggtgcccaccaatatttcgtcgacgctacaccggtcgtcagcgatgcctttttcgatggagcttggcacactgttctgatcggaacgcttggtgctggaggtcgcggcctgttcgcactcgatgtaaccaagccggacgatgtcaagctgctttgggaatacgatagcagtaccgactcggaccttggttacaccttctccaaacctaccgtagccagactgcacagcggacaatgggcagtagttaccggcaacggctatggaagcgataatgacaaggcagctttactgctgattgatttgaaaaagggaacgctgatcaagaagctggaagtccaaagcgagcgcggaatagccaatggcctatcgacgcctcgcctggctgataacaacagcgatggcattgctgactacgcctatgctggcgatctgcagggaaatatctggcgcttcgatttgatcggcaatacccgcaacgacgacccagacacaaatacctctatcaatcccttcaagcccggagatgtagatccttctgctttcagagtatcgttcagcggcgccccgcttttccgtgctcgcgccgacaacaatactcgtcagcccatcacggctccgcctaccttggtacgccatcctagccgtaagggctacatcgtcatcgtaggtacaggaaaatacttcgaggacgatgacgctcaggccgataccagccgagccatgacgctctatggtatctgggatcgccagaccaagggcgaaagcgcaaacagtaccccaaccatcgaccgcaacgccctcacagcccaaaccatgacaacagaggcgaactccacattcggtagcgtgaacaggaatattcggcttattagccaaaacccggtgaagtggtacaaagacggagcaaccggtaccgcgaactcggatgtggctagctatggctggcgactgaatctggaggtcaatagcagcaagaaaggcgaaatgatgatcgaagatatgttcgctgccggccaagtgcttctattgcagaccttgacaccgaacgacgacccttgtgacagcggctctaccagctggacctacggcctcaatccatatactggcggacgtaccagtttcaccgtcttcgatctcaaacgtgcgggtatagtggactctggctcggattacaacggctcggtcgtatccgccttccaacaggatggactaggtggcttggccattacccagaacgaacagcgtcaatccgaggcttgcactggtgatgagtgcatcatcttcaaccccagcgacaagagtaacggacgacaaacctggcgggtcgtcgaggagaaatgaacatgaaccccttacgtcttctcgccacagctcttgcagctctagctctggcttgcccaacctttgccttgagtgccacgaatacgttcgagaatgtgggcgtggtcgaggatgttcatcctgccgccggtctggtagtagtcgatgggcagacatatcgcttgcccaaccgtgtccaacaacaggactcgccggtcatattcttggtacgtcagggacagacagtgtctttctccggcaaactcaccagcgacctgccagaaatcgagtcgttctacattatcaagcaggcccctctcgttcccttcggatcggagcagcaacaatgaagtcgaacagaggcttcactctcatcgagttgatgatcgtcgtagtaatcatcgctattcttgctggtatcgcctaccccagctacgacgaatacgtgaagcgcgggaatcgcaccgaaggacaggcattactcagcgaagcagccgctactcaagagcgctatttttcacagaacaatacttatatcactacccaagccgacatcggcaagctgcatatgcgcaacacatcgggcaccacagtgaagtcctccacaggcaaatacagccttaccgtcgatacggtagccaacgacggaggttatcgccttatcgctaaccaggcattcaacgatcttgattgtggcaacctgaccttgaccgccaacggcgagaaaggccggactggaagcaagaagagcgttgcagaatgctggcgctaaagcgccgagacaagaaaaaggcaaagcccggcataagccgggctttttcaggtgcgcaaaaattccgattacaaagccttgacccgcagttccttgggcatcgagaaggtaatgttctcctcccgtccctccagttcctgctcttccgacgccccccactcacgtagctgggcgatcactccgcgcaccagcacttccggcgcggaggcgcctgcggtgattccgatgcgacgcacaccgtcgaaccagccgcgttgcatgtcctcggcgccgtcgatcaggtaggccggcgtgcccatgcgctcggcgagttcgcgcaggcggttggagttggaactgttggggctgcccaccaccaggaccatgtcgcactggtcggccagttccttcacggcatcctggcggttctgggtggcatagcagatgtcgttcttgcgcggcccctggatctgcgggaacttggcgcgcagggcatcgatgaccttcgaggtgtcgtccatcgacagggtggtctgggtcacgtagtgcagggcttcgggcttgcgcacctccagcgcggcgacgtcggcctcgtcctccaccaggtagatggcaccgccgttgctggcatcgtactggcccatggtgccttccacctcggggtggccttcatgcccgatcagcacgcattcgtggccgtcgcggctgtagcgcaccacttccatgtgcaccttggtcaccagcgggcaggtcgcgtcgaaaaccttcaggccgcgcccctcggcttccttgcggaccgcctgggaaacgccgtgggcgctgaagatgacgatgacgttgtccggcacctgatcgagttcctcgacgaagatggcgccgcgctggcgcaggttgtccacgacgaacttgttgtgcaccacctcgtgacgcacgtagatcggcgggccgaagacatcgagggcacggttgacgatctcgatggcgcgatccacgccggcgcagaagccgcggggattggcgagtttgatttgcatggcggtctcgtgggcgacgcggtgattggacgaatgaaccttgctaccgccctccccgcttgggaagggcgcagcgaccgacggttcaggccggctggacgtcgat

SEQ ID NO: 2 - DNA, 306 bp, Pseudomonas aeruginosa
tcgccgatccaatgccaaggagtacctgggcaatcagagcctactcacggctgccggggccggcattgccaagctcctggacgccgacgagaacaacaccagtaccgtcttcagcggcaacggcaccagcttcgggacgaccggaaccaacagcaactcggccctcaacagcatcctctccggcggcgtcagcgacatccggcagtggatgaacaagttgtacggggaggccttcgccgccgtctacgtgcagccaggtgcgcgggtcgcagtgcatctcgatcagcaactggcgatcgactatga

SEQ ID NO: 3 - protein, 101 aa, Pseudomonas aeruginosa
SPIQCQGVPGQSEPTHGCRGRHCQAPGRRREQHQYRLQRQRHQLRDDRNQQQLGPQQHPLRRRQRHPAVDEQVVRGGLRRRLRAARCAGRSASRSATGDRL

SEQ ID NO: 4 - DNA, 369 bp, Pseudomonas aeruginosa
cgccgatccaatgccaaggagtacctgggcaatcagagcctactcacggctgccggggccggcattgccaagctcctggacgccgacgagaacaacaccagtaccgtcttcagcggcaacggcaccagcttcgggacgaccggaaccaacagcaactcggccctcaacagcatcctctccggcggcgtcagcgacatccggcagtggatgaacaagttgtacggggaggccttcgccgccgtctacgtgcagccaggtgcgcgggtcgcagtgcatctcgatcagcaactggcgatcgactatgaactcaagggccgcaaggtcgattacagctctggagccgctcatgcaacagcagacttggactaa

SEQ ID NO: 5 - protein, 122 aa, Pseudomonas aeruginosa
RRSNAKEYLGNQSLLTAAGAGIAKLLDADENNTSTVFSGNGTSFGTTGTNSNSALNSILSGGVSDIRQWMNKLYGEAFAAVYVQPGARVAVHLDQQLAIDYELKGRKVDYSSGAAHATADLD

SEQ ID NO: 6 - DNA, 561 bp, Pseudomonas aeruginosa
tcggcctggtcattcgcggaggcatcctgctgcggatcgattgggcgccgcagcgtttgcctggcatcgaggagcagccggccacggctgttgcctatcgagctggtcgcacctcgctcccagacgtcgagcatgttggcctcgccgtggggcagcatctcctccttgctggtggagcacgctgccagggtcagcgcgcaggccaggccggcgcagagacgaagaagggggttagtccaagtctgctgttgcatgagcggctccagagctgtaatcgaccttgcggcccttgagttcatagtcgatcgccagttgctgatcgagatgcactgcgacccgcgcacctggctgcacgtagacggcggcgaaggcctccccgtacaacttgttcatccactgccggatgtcgctgacgccgccggagaggatgctgttgagggccgagttgctgttggttccggtcgtcccgaagctggtgccgttgccgctgaagacggtactggtgttgttctcgtcggcgtccaggagcttggcaatgccggccccggcagccgtgagtag

SEQ ID NO: 7 - protein, 186 aa, Pseudomonas aeruginosa
SAWSFAEASCCGSIGRRSVCLASRSSRPRLLPIELVAPRSQTSSMLASPWGSISSLLVEHAARVSAQARPAQRRRRGLVQVCCCMSGSRAVIDLAALEFIVDRQLLIEMHCDPRTWLHVDGGEGLPVQLVHPLPDVADAAGEDAVEGRVAVGSGRPEAGAVAAEDGTGVVLVGVQELGNAGPGSRE

SEQ ID NO: 8 - DNA, 579 bp, Pseudomonas aeruginosa
acaagttgtacggggaggccttcgccgccgtctacgtgcagccaggtgcgcgggtcgcagtgcatctcgatcagcaactggcgatcgactatgaactcaagggccgcaaggtcgattacagctctggagccgctcatgcaacagcagacttggactaacccccttcttcgtctctgcgccggcctggcctgcgcgctgaccctggcagcgtgctccaccagcaaggaggagatgctgccccacggcgaggccaacatgctcgacgtctgggagcgaggtgcgaccagctcgataggcaacagccgtggccggctgctcctcgatgccaggcaaacgctgcggcgcccaatcgatccgcagcaggatgcctccgcgaatgaccaggccgactacacccgcacggccagcaacgagatccacagtcagttcaaacgactgcccaatcccgacctggtgatgtatgtgttcccgcacctggccggcagcgatcccgccccggtaccgggctacaccaccgtgttccccttctaccagcgagtccagtacgccatgccgggcgaacgcacggaggactattga

SEQ ID NO: 9 - protein, 192 aa, Pseudomonas aeruginosa
TSCTGRPSPPSTCSQVRGSQCISISNWRSTMNSRAARSITALEPLMQQQTWTNPLLRLCAGLACALTLAACSTSKEEMLPHGEANMLDVWERGATSSIGNSRGRLLLDARQTLRRPIDPQQDASANDQADYTRTASNEIHSQFKRLPNPDLVMYVFPHLAGSDPAPVPGYTTVFPFYQRVQYAMPGERTEDY

SEQ ID NO: 10 - DNA, 933 bp, Pseudomonas aeruginosa
tctcgtcctgggcgtagaactggacaatccagggtgaggtttcgtgctcgtcgaaggagttctgcagggcttctttcaatgcgtcccgggcgttctgcatccaattgggatcgcggccctcggtgcccaagggcaccagttcgaagaatgcggcgcgcgaacgcccatcctccaggagcatcacttgctcgtcgggcaggtactcagcccagggcagcaggtctacgaacgatgggtcgtgatcgtagaggcgtgacgcttcggcctgcgtggcgccattcttgctcccggtgttgggcagaggaatacccatggcggccagtcgcgccagatagcgctcagtcgcttcttccgcggccgctacgtccagcgctcctgaatcttcgggagcgtctgccggtaccgactgaggctgtgtgcgaccgcgcagaagggtttgaaaaaagcccatcaatagtcctccgtgcgttcgcccggcatggcgtactggactcgctggtagaaggggaacacggtggtgtagcccggtaccggggcgggatcgctgccggccaggtgcgggaacacatacatcaccaggtcgggattgggcagtcgtttgaactgactgtggatctcgttgctggccgtgcgggtgtagtcggcctggtcattcgcggaggcatcctgctgcggatcgattgggcgccgcagcgtttgcctggcatcgaggagcagccggccacggctgttgcctatcgagctggtcgcacctcgctcccagacgtcgagcatgttggcctcgccgtggggcagcatctcctccttgctggtggagcacgctgccagggtcagcgcgcaggccaggccggcgcagagacgaagaagggggttagtccaagtctgctgttgcatgagcggctccagagctgtaatcgaccttgcggcccttga

SEQ ID NO: 11 - protein, 310 aa, Pseudomonas aeruginosa
SRPGRRTGQSRVRFRARRRSSAGLLSMRPGRSASNWDRGPRCPRAPVRRMRRANAHPPGASLARRAGTQPRAAGLRTMGRDRRGVTLRPAWRHSCSRCWAEEYPWRPVAPDSAQSLLPRPLRPALLNLRERLPVPTEAVCDRAEGFEKSPSIVLRAFARHGVLDSLVEGEHGGVARYRGGIAAGQVREHIHHQVGIGQSFELTVDLVAGRAGVVGLVIRGGILLRIDWAPQRLPGIEEQPATAVAYRAGRTSLPDVEHVGLAVGQHLLLAGGARCQGQRAGQAGAETKKGVSPSLLLHERLQSCNRPCGP

SEQ ID NO: 12 - DNA, 3141 bp, Pseudomonas aeruginosa
ccaggccgactacacccgcacggccagcaacgagatccacagtcagttcaaacgactgcccaatcccgacctggtgatgtatgtgttcccgcacctggccggcagcgatcccgccccggtaccgggctacaccaccgtgttccccttctaccagcgagtccagtacgccatgccgggcgaacgcacggaggactattgatgggcttttttcaaacccttctgcgcggtcgcacacagcctcagtcggtaccggcagacgctcccgaagattcaggagcgctggacgtagcggccgcggaagaagcgactgagcgctatctggcgcgactggccgccatgggtattcctctgcccaacaccgggagcaagaatggcgccacgcaggccgaagcgtcacgcctctacgatcacgacccatcgttcgtagacctgctgccctgggctgagtacctgcccgacgagcaagtgatgctcctggaggatgggcgttcgcgcgccgcattcttcgaactggtgcccttgggcaccgagggccgcgatcccaattggatgcagaacgcccgggacgcattgaaagaagccctgcagaactccttcgacgagcacgaaacctcaccctggattgtccagttctacgcccaggacgagatcagctgggacaatttccaggagcagttgaggcagtacgtccatcctcgagcgcgaggatcggccttcagcgagatgtacctggcgctcatgaagcatcacctggagggcatttcgaagccgggcggactgttcgtcgacaccgccgtcagcaagctgccctggcgaggacaacagcgccgcgtgcggatggtcgtctaccgccggatccgcaaggaggatgcgcagattcgcggacaggacccggcggcgtacctgaaatccatctgcgagcgtatccaaggcggcctggcgaacgccggcatcgtcgcttcgcgcatgggcggacaggagatcaggaactggttgatccgctggttcaacccgcacccggatcacctcggccaggccgaggcggacctacgtcgcttctacgaactggtatgccgtccggacgaaccgatcctgcaggatgaattgccactggccgacggcactgacttctcccagaacctgttctatcggcagcctgtttccgatgccacccagggcgtatggctcttcgatgccatgccgcaccgagtgattgtggtcgaccagttgaacaaagcgccgctgacaggccacttcaccggcgagacgctcaaaggcgatggcctcaacgccctgttcgatcgaatgcccgaggacacgctgctgtgcatcaccatggtcgtgacgccgcaggacatgctggaagggcatctgcagcagctctcgaaaaaggccgttggtgacacccaggcctcgatccacacccgcgaggacgtggccaccgttcgacgcctgatcggccgggagcacaagctctatcgcggagcgatcgctctgttcgtgcgcggccgcgaccatacccagttggaggaacgctgcatcaccctgagcaacgtactgctcggcgccggcctggtgccggtcgaaccgcagaacgaagtcggaccgctgaacagctacctgcgctggctcccctcaaacttcgatccaaacgagaagcgagccctggagtggtacacccagatgatgttcgctcagcacatcgccaacctgtcgcccatctgggggcgcaccaccggtaccggacaccctggcttcacgctgttcaaccgtggcggcgcgccgttgaccttcgacccgttcaacaagctggaccggcagatgaatgcccacggcttcatcttcgggccaactggctccggcaagtcggcgtccctgaccaacctcatctgccagatgctcgccatgtacctgccgcggatgttcgtcgcggaagcgggcaacagcttcggcctgctggccgacttagccaagcggtttggcctctcggtccaccgggtgcgcctcgccccgggctccggcgtcagcctggcgccgttcgcggacgccatcaagctggtcgagagccccgaccaagtgaaggtgctggacgccgaagacatcgaggcctcggactcggtccagggcagcaaggccgacctcgaggacgaccagcgagacatcctgggcgagatggagatcgtcgcccgcctcatgattaccggtggcgaagagaaggaagatgcgcgcctgacccgtgccgatcgcagcgccgtccgccaggcgatcctggcggcggccaggacctgcgccgccgcgaaccgcacggtactgacccaagacgtgcgcgatgcgctctacgaggcctccaggagcgatagcaccgcgccagaacgccgcgcgcggatcgccgaaatggcggaagccatgcagatgttctgcatgggcgccgacggcgagatgttcaatcgcgaaggcacgccctggcctgaggccgaccttaccgtggtggatttcgcaacgtacgcgcgcgaaggctacgccgcccagctcgggatcgcctacatctcgctgctgaacaccgtgaacaacatcgccgaacgcgaccagttcaagggccggccaatcgtcaagatcaccgatgaggggcacatcatcaccaagcacccgctgctgctgccctacgccatgaagatcaccaagatgtggcggaaactgggcgcctggttctggctcgccacccagaacatcgacgacatcccagcctccggggcgccgatgctgaacatgatcgagtggtggttgtgcctgaacatgccccccgacgaagtagagaagatatccaggttccgcgagctgtcgccggcgcagaagtcgatgatgctctcggcccgcaaggaaagcggcaagttcaccgagggcgtgctcctggccaagggcaaagaatacctcgtccgtgtggttcccccgagtctctacctggccctggccatgaccgaaaacgaagaaaagaaccagcgctacaacatcatgcaagccaccggctgcgacgagctcgaggcggccttgcaggtcgcagcggatctcgacaaggcgcgcggcctgccacccttccccattgttttcccagaccaaccggcagtggagtgccaggacgaatga

SEQ ID NO: 13 - protein, 1046 aa, Pseudomonas aeruginosa
PGRLHPHGQQRDPQSVQTTAQSRPGDVCVPAPGRQRSRPGTGLHHRVPLLPASPVRHAGRTHGGLLMGFFQTLLRGRTQPQSVPADAPEDSGALDVAAAEEATERYLARLAAMGIPLPNTGSKNGATQAEASRLYDHDPSFVDLLPWAEYLPDEQVMLLEDGRSRAAFFELVPLGTEGRDPNWMQNARDALKEALQNSFDEHETSPWIVQFYAQDEISWDNFQEQLRQYVHPRARGSAFSEMYLALMKHHLEGISKPGGLFVDTAVSKLPWRGQQRRVRMVVYRRIRKEDAQIRGQDPAAYLKSICERIQGGLANAGIVASRMGGQEIRNWLIRWFNPHPDHLGQAEADLRRFYELVCRPDEPILQDELPLADGTDFSQNLFYRQPVSDATQGVWLFDAMPHRVIVVDQLNKAPLTGHFTGETLKGDGLNALFDRMPEDTLLCITMVVTPQDMLEGHLQQLSKKAVGDTQASIHTREDVATVRRLIGREHKLYRGAIALFVRGRDHTQLEERCITLSNVLLGAGLVPVEPQNEVGPLNSYLRWLPSNFDPNEKRALEWYTQMMFAQHIANLSPIWGRTTGTGHPGFTLFNRGGAPLTFDPFNKLDRQMNAHGFIFGPTGSGKSASLTNLICQMLAMYLPRMFVAEAGNSFGLLADLAKRFGLSVHRVRLAPGSGVSLAPFADAIKLVESPDQVKVLDAEDIEASDSVQGSKADLEDDQRDILGEMEIVARLMITGGEEKEDARLTRADRSAVRQAILAAARTCAAANRTVLTQDVRDALYEASRSDSTAPERRARIAEMAEAMQMFCMGADGEMFNREGTPWPEADLTVVDFATYAREGYAAQLGIAYISLLNTVNNIAERDQFKGRPIVKITDEGHIITKHPLLLPYAMKITKMWRKLGAWFWLATQNIDDIPASGAPMLNMIEWWLCLNMPPDEVEKISRFRELSPAQKSMMLSARKESGKFTEGVLLAKGKEYLVRVVPPSLYLALAMTENEEKNQRYNIMQATGCDELEAALQVAADLDKARGLPPFPIVFPDQPAVECQDE

SEQ ID NO: 14 - DNA, 657 bp, Pseudomonas aeruginosa
gtacctgcccgacgagcaagtgatgctcctggaggatgggcgttcgcgcgccgcattcttcgaactggtgcccttgggcaccgagggccgcgatcccaattggatgcagaacgcccgggacgcattgaaagaagccctgcagaactccttcgacgagcacgaaacctcaccctggattgtccagttctacgcccaggacgagatcagctgggacaatttccaggagcagttgaggcagtacgtccatcctcgagcgcgaggatcggccttcagcgagatgtacctggcgctcatgaagcatcacctggagggcatttcgaagccgggcggactgttcgtcgacaccgccgtcagcaagctgccctggcgaggacaacagcgccgcgtgcggatggtcgtctaccgccggatccgcaaggaggatgcgcagattcgcggacaggacccggcggcgtacctgaaatccatctgcgagcgtatccaaggcggcctggcgaacgccggcatcgtcgcttcgcgcatgggcggacaggagatcaggaactggttgatccgctggttcaacccgcacccggatcacctcggccaggccgaggcggacctacgtcgcttctacgaactggtatgccgtccggacgaaccgatcctgcaggatga

SEQ ID NO: 15 - protein, 218 aa, Pseudomonas aeruginosa
VPARRASDAPGGWAFARRILRTGALGHRGPRSQLDAERPGRIERSPAELLRRARNLTLDCPVLRPGRDQLGQFPGAVEAVRPSSSARIGLQRDVPGAHEASPGGHFEAGRTVRRHRRQQAALARTTAPRADGRLPPDPQGGCADSRTGPGGVPEIHLRAYPRRPGERRHRRFAHGRTGDQELVDPLVQPAPGSPRPGRGGPTSLLRTGMPSGRTDPAG

SEQ ID NO: 16 - DNA, 435 bp, Pseudomonas aeruginosa
gtccgcctcggcctggccgaggtgatccgggtgcgggttgaaccagcggatcaaccagttcctgatctcctgtccgcccatgcgcgaagcgacgatgccggcgttcgccaggccgccttggatacgctcgcagatggatttcaggtacgccgccgggtcctgtccgcgaatctgcgcatcctccttgcggatccggcggtagacgaccatccgcacgcggcgctgttgtcctcgccagggcagcttgctgacggcggtgtcgacgaacagtccgcccggcttcgaaatgccctccaggtgatgcttcatgagcgccaggtacatctcgctgaaggccgatcctcgcgctcgaggatggacgtactgcctcaactgctcctggaaattgtcccagctgatctcgtcctgggcgtagaactggacaatccagggtga

SEQ ID NO: 17 - protein, 144 aa, Pseudomonas aeruginosa
VRLGLAEVIRVRVEPADQPVPDLLSAHARSDDAGVRQAALDTLADGFQVRRRVLSANLRILLADPAVDDHPHAALLSSPGQLADGGVDEQSARLRNALQVMLHERQVHLAEGRSSRSRMDVLPQLLLEIVPADLVLGVELDNPG

SEQ ID NO: 18 - DNA, 588 bp, Pseudomonas aeruginosa
ggggagccagcgcaggtagctgttcagcggtccgacttcgttctgcggttcgaccggcaccaggccggcgccgagcagtacgttgctcagggtgatgcagcgttcctccaactgggtatggtcgcggccgcgcacgaacagagcgatcgctccgcgatagagcttgtgctcccggccgatcaggcgtcgaacggtggccacgtcctcgcgggtgtggatcgaggcctgggtgtcaccaacggcctttttcgagagctgctgcagatgcccttccagcatgtcctgcggcgtcacgaccatggtgatgcacagcagcgtgtcctcgggcattcgatcgaacagggcgttgaggccatcgcctttgagcgtctcgccggtgaagtggcctgtcagcggcgctttgttcaactggtcgaccacaatcactcggtgcggcatggcatcgaagagccatacgccctgggtggcatcggaaacaggctgccgatagaacaggttctgggagaagtcagtgccgtcggccagtggcaattcatcctgcaggatcggttcgtccggacggcataccagttcgtagaagcgacgtag

SEQ ID NO: 19 - protein, 195 aa, Pseudomonas aeruginosa
GEPAQVAVQRSDFVLRFDRHQAGAEQYVAQGDAAFLQLGMVAAAHEQSDRSAIELVLPADQASNGGHVLAGVDRGLGVTNGLFRELLQMPFQHVLRRHDHGDAQQRVLGHSIEQGVEAIAFERLAGEVACQRRFVQLVDHNHSVRHGIEEPYALGGIGNRLPIEQVLGEVSAVGQWQFILQDRFVRTAYQFVEAT

SEQ ID NO: 20 - DNA, 330 bp, Pseudomonas aeruginosa
agcttgtgctcccggccgatcaggcgtcgaacggtggccacgtcctcgcgggtgtggatcgaggcctgggtgtcaccaacggcctttttcgagagctgctgcagatgcccttccagcatgtcctgcggcgtcacgaccatggtgatgcacagcagcgtgtcctcgggcattcgatcgaacagggcgttgaggccatcgcctttgagcgtctcgccggtgaagtggcctgtcagcggcgctttgttcaactggtcgaccacaatcactcggtgcggcatggcatcgaagagccatacgccctgggtggcatcggaaacaggctgccgatag

SEQ ID NO: 21 - protein, 109 aa, Pseudomonas aeruginosa
SLCSRPIRRRTVATSSRVWIEAWVSPTAFFESCCRCPSSMSCGVTTMVMHSSVSSGIRSNRALRPSPLSVSPVKWPVSGALFNWSTTITRCGMASKSHTPWVASETGCR

SEQ ID NO: 22 - DNA, 957 bp, Pseudomonas aeruginosa
cacccaggcctcgatccacacccgcgaggacgtggccaccgttcgacgcctgatcggccgggagcacaagctctatcgcggagcgatcgctctgttcgtgcgcggccgcgaccatacccagttggaggaacgctgcatcaccctgagcaacgtactgctcggcgccggcctggtgccggtcgaaccgcagaacgaagtcggaccgctgaacagctacctgcgctggctcccctcaaacttcgatccaaacgagaagcgagccctggagtggtacacccagatgatgttcgctcagcacatcgccaacctgtcgcccatctgggggcgcaccaccggtaccggacaccctggcttcacgctgttcaaccgtggcggcgcgccgttgaccttcgacccgttcaacaagctggaccggcagatgaatgcccacggcttcatcttcgggccaactggctccggcaagtcggcgtccctgaccaacctcatctgccagatgctcgccatgtacctgccgcggatgttcgtcgcggaagcgggcaacagcttcggcctgctggccgacttagccaagcggtttggcctctcggtccaccgggtgcgcctcgccccgggctccggcgtcagcctggcgccgttcgcggacgccatcaagctggtcgagagccccgaccaagtgaaggtgctggacgccgaagacatcgaggcctcggactcggtccagggcagcaaggccgacctcgaggacgaccagcgagacatcctgggcgagatggagatcgtcgcccgcctcatgattaccggtggcgaagagaaggaagatgcgcgcctgacccgtgccgatcgcagcgccgtccgccaggcgatcctggcggcggccaggacctgcgccgccgcgaaccgcacggtactgacccaagacgtgcgcgatgcgctctacgaggcctccaggagcgatag

SEQ ID NO: 23 - protein, 318 aa, Pseudomonas aeruginosa
HPGLDPHPRGRGHRSTPDRPGAQALSRSDRSVRARPRPYPVGGTLHHPEQRTARRRPGAGRTAERSRTAEQLPALAPLKLRSKREASPGVVHPDDVRSAHRQPVAHLGAHHRYRTPWLHAVQPWRRAVDLRPVQQAGPADECPRLHLRANWLRQVGVPDQPHLPDARHVPAADVRRGSGQQLRPAGRLSQAVWPLGPPGAPRPGLRRQPGAVRGRHQAGREPRPSEGAGRRRHRGLGLGPGQQGRPRGRPARHPGRDGDRRPPHDYRWRREGRCAPDPCRSQRRPPGDPGGGQDLRRREPHGTDPRRARCALRGLQER

SEQ ID NO: 24 - DNA, 330 bp, Pseudomonas aeruginosa
gtcggccagcaggccgaagctgttgcccgcttccgcgacgaacatccgcggcaggtacatggcgagcatctggcagatgaggttggtcagggacgccgacttgccggagccagttggcccgaagatgaagccgtgggcattcatctgccggtccagcttgttgaacgggtcgaaggtcaacggcgcgccgccacggttgaacagcgtgaagccagggtgtccggtaccggtggtgcgcccccagatgggcgacaggttggcgatgtgctgagcgaacatcatctgggtgtaccactccagggctcgcttctcgtttggatcgaagtttga

SEQ ID NO: 25 - protein, 109 aa, Pseudomonas aeruginosa
VGQQAEAVARFRDEHPRQVHGEHLADEVGQGRRLAGASWPEDEAVGIHLPVQLVERVEGQRRAATVEQREARVSGTGGAPPDGRQVGDVLSEHHLGVPLQGSLLVWIEV

SEQ ID NO: 26 - DNA, 642 bp, Pseudomonas aeruginosa
agcgcatcgcgcacgtcttgggtcagtaccgtgcggttcgcggcggcgcaggtcctggccgccgccaggatcgcctggcggacggcgctgcgatcggcacgggtcaggcgcgcatcttccttctcttcgccaccggtaatcatgaggcgggcgacgatctccatctcgcccaggatgtctcgctggtcgtcctcgaggtcggccttgctgccctggaccgagtccgaggcctcgatgtcttcggcgtccagcaccttcacttggtcggggctctcgaccagcttgatggcgtccgcgaacggcgccaggctgacgccggagcccggggcgaggcgcacccggtggaccgagaggccaaaccgcttggctaagtcggccagcaggccgaagctgttgcccgcttccgcgacgaacatccgcggcaggtacatggcgagcatctggcagatgaggttggtcagggacgccgacttgccggagccagttggcccgaagatgaagccgtgggcattcatctgccggtccagcttgttgaacgggtcgaaggtcaacggcgcgccgccacggttgaacagcgtgaagccagggtgtccggtaccggtggtgcgcccccagatgggcgacaggttggcgatgtgctga

SEQ ID NO: 27 - protein, 213 aa, Pseudomonas aeruginosa
SASRTSWVSTVRFAAAQVLAAARIAWRTALRSARVRRASSFSSPPVIMRRATISISPRMSRWSSSRSALLPWTESEASMSSASSTFTWSGLSTSLMASANGARLTPEPGARRTRWTERPNRLAKSASRPKLLPASATNIRGRYMASIWQMRLVRDADLPEPVGPKMKPWAFICRSSLLNGSKVNGAPPRLNSVKPGCPVPVVRPQMGDRLAMC

SEQ ID NO: 28 - DNA, 1407 bp, Pseudomonas aeruginosa
gcgcctgttgggccgtatcaggctgtggatgttgttgcagccattcatccaagagctgctttatctgcgggacgatatcccggcgatcgactgccctcagttgaatctgctgcagctcctctatcagtacaggagcgcatatccttagcgtctgcagggcatcctcttcggggttctgcaggatctgggtcaggttgtcgatcaggttctgggtcagcgaattcagaactctcattcgtcctggcactccactgccggttggtctgggaaaacaatggggaagggtggcaggccgcgcgccttgtcgagatccgctgcgacctgcaaggccgcctcgagctcgtcgcagccggtggcttgcatgatgttgtagcgctggttcttttcttcgttttcggtcatggccagggccaggtagagactcgggggaaccacacggacgaggtattctttgcccttggccaggagcacgccctcggtgaacttgccgctttccttgcgggccgagagcatcatcgacttctgcgccggcgacagctcgcggaacctggatatcttctctacttcgtcggggggcatgttcaggcacaaccaccactcgatcatgttcagcatcggcgccccggaggctgggatgtcgtcgatgttctgggtggcgagccagaaccaggcgcccagtttccgccacatcttggtgatcttcatggcgtagggcagcagcagcgggtgcttggtgatgatgtgcccctcatcggtgatcttgacgattggccggcccttgaactggtcgcgttcggcgatgttgttcacggtgttcagcagcgagatgtaggcgatcccgagctgggcggcgtagccttcgcgcgcgtacgttgcgaaatccaccacggtaaggtcggcctcaggccagggcgtgccttcgcgattgaacatctcgccgtcggcgcccatgcagaacatctgcatggcttccgccatttcggcgatccgcgcgcggcgttctggcgcggtgctatcgctcctggaggcctcgtagagcgcatcgcgcacgtcttgggtcagtaccgtgcggttcgcggcggcgcaggtcctggccgccgccaggatcgcctggcggacggcgctgcgatcggcacgggtcaggcgcgcatcttccttctcttcgccaccggtaatcatgaggcgggcgacgatctccatctcgcccaggatgtctcgctggtcgtcctcgaggtcggccttgctgccctggaccgagtccgaggcctcgatgtcttcggcgtccagcaccttcacttggtcggggctctcgaccagcttgatggcgtccgcgaacggcgccaggctgacgccggagcccggggcgaggcgcacccggtggaccgagaggccaaaccgcttggctaa

SEQ ID NO: 29 - protein, 468 aa, Pseudomonas aeruginosa
APVGPYQAVDVVAAIHPRAALSAGRYPGDRLPSVESAAAPLSVQERISLASAGHPLRGSAGSGSGCRSGSGSANSELSFVLALHCRLVWENNGEGWQAARLVEIRCDLQGRLELVAAGGLHDVVALVLFFVFGHGQGQVETRGNHTDEVFFALGQEHALGELAAFLAGREHHRLLRRRQLAEPGYLLYFVGGHVQAQPPLDHVQHRRPGGWDVVDVLGGEPEPGAQFPPHLGDLHGVGQQQRVLGDDVPLIGDLDDWPALELVAFGDVVHGVQQRDVGDPELGGVAFARVRCEIHHGKVGLRPGRAFAIEHLAVGAHAEHLHGFRHFGDPRAAFWRGAIAPGGLVERIAHVLGQYRAVRGGAGPGRRQDRLADGAAIGTGQARIFLLFATGNHEAGDDLHLAQDVSLVVLEVGLAALDRVRGLDVFGVQHLHLVGALDQLDGVRERRQADAGARGEAHPVDREAKPLG

SEQ ID NO: 30 - DNA, 798 bp, Pseudomonas aeruginosa
ggggcacatcatcaccaagcacccgctgctgctgccctacgccatgaagatcaccaagatgtggcggaaactgggcgcctggttctggctcgccacccagaacatcgacgacatcccagcctccggggcgccgatgctgaacatgatcgagtggtggttgtgcctgaacatgccccccgacgaagtagagaagatatccaggttccgcgagctgtcgccggcgcagaagtcgatgatgctctcggcccgcaaggaaagcggcaagttcaccgagggcgtgctcctggccaagggcaaagaatacctcgtccgtgtggttcccccgagtctctacctggccctggccatgaccgaaaacgaagaaaagaaccagcgctacaacatcatgcaagccaccggctgcgacgagctcgaggcggccttgcaggtcgcagcggatctcgacaaggcgcgcggcctgccacccttccccattgttttcccagaccaaccggcagtggagtgccaggacgaatgagagttctgaattcgctgacccagaacctgatcgacaacctgacccagatcctgcagaaccccgaagaggatgccctgcagacgctaaggatatgcgctcctgtactgatagaggagctgcagcagattcaactgagggcagtcgatcgccgggatatcgtcccgcagataaagcagctcttggatgaatggctgcaacaacatccacagcctgatacggcccaacaggcgctcattgaggccgtggaccgcgcggagatcctacagcggaggcaagcgtga

SEQ ID NO: 31 - protein, 265 aa, Pseudomonas aeruginosa
GAHHHQAPAAAALRHEDHQDVAETGRLVLARHPEHRRHPSLRGADAEHDRVVVVPEHAPRRSREDIQVPRAVAGAEVDDALGPQGKRQVHRGRAPGQGQRIPRPCGSPESLPGPGHDRKRRKEPALQHHASHRLRRARGGLAGRSGSRQGARPATLPHCFPRPTGSGVPGRMRVLNSLTQNLIDNLTQILQNPEEDALQTLRICAPVLIEELQQIQLRAVDRRDIVPQIKQLLDEWLQQHPQPDTAQQALIEAVDRAEILQRRQA

SEQ ID NO: 32 - DNA, 354 bp, Pseudomonas aeruginosa
ccgaaaacgaagaaaagaaccagcgctacaacatcatgcaagccaccggctgcgacgagctcgaggcggccttgcaggtcgcagcggatctcgacaaggcgcgcggcctgccacccttccccattgttttcccagaccaaccggcagtggagtgccaggacgaatgagagttctgaattcgctgacccagaacctgatcgacaacctgacccagatcctgcagaaccccgaagaggatgccctgcagacgctaaggatatgcgctcctgtactgatagaggagctgcagcagattcaactgagggcagtcgatcgccgggatatcgtcccgcagataaagcagctcttggatga

SEQ ID NO: 33 - protein, 117 aa, Pseudomonas aeruginosa
PKTKKRTSATTSCKPPAATSSRRPCRSQRISTRRAACHPSPLFSQTNRQWSARTNESSEFADPEPDRQPDPDPAEPRRGCPADAKDMRSCTDRGAAADSTEGSRSPGYRPADKAALG

SEQ ID NO: 34 - DNA, 645 bp, Pseudomonas aeruginosa
gtcaataagttcgttgtctttcgcacatttctccagtcgagcctggtccagttcaggaaagtccaatgtgccgccaggcagcccgcccccgttgccggccgactgagcgaagatcgcatcgatagcgctccagaaggctttggcgccgccttggatccccgcgcactccaccaggcgagcctggtggcgggccgcctcgccatgcatctgcaggggaagatggcgccaaaccaggttcacgtccggatggctgtctacccagcgcttaagccgcggggtgtagaccttgcagaaggggcactccaggtcggcgtattcattgatcgtccagcgcgctttcgcatcgccgtagaggctgtggttggctggcaggcccttcaccagaagctctacccctacggcggatgcagccagcaagaccagcagcagccccgcccagggcagggcgggaccttgaaatcgtttggctgcccagccgcccttcaagagtctcacgcttgcctccgctgtaggatctccgcgcggtccacggcctcaatgagcgcctgttgggccgtatcaggctgtggatgttgttgcagccattcatccaagagctgctttatctgcgggacgatatcccggcgatcgactgccctcagttga

SEQ ID NO: 35 - protein, 214 aa, Pseudomonas aeruginosa
VNKFVVFRTFLQSSLVQFRKVQCAARQPAPVAGRLSEDRIDSAPEGFGAALDPRALHQASLVAGRLAMHLQGKMAPNQVHVRMAVYPALKPRGVDLAEGALQVGVFIDRPARFRIAVEAVVGWQALHQKLYPYGGCSQQDQQQPRPGQGGTLKSFGCPAALQESHACLRCRISARSTASMSACWAVSGCGCCCSHSSKSCFICGTISRRSTALS

SEQ ID NO: 36 - DNA, 699 bp, Pseudomonas aeruginosa
ggccgtggaccgcgcggagatcctacagcggaggcaagcgtgagactcttgaagggcggctgggcagccaaacgatttcaaggtcccgccctgccctgggcggggctgctgctggtcttgctggctgcatccgccgtaggggtagagcttctggtgaagggcctgccagccaaccacagcctctacggcgatgcgaaagcgcgctggacgatcaatgaatacgccgacctggagtgccccttctgcaaggtctacaccccgcggcttaagcgctgggtagacagccatccggacgtgaacctggtttggcgccatcttcccctgcagatgcatggcgaggcggcccgccaccaggctcgcctggtggagtgcgcggggatccaaggcggcgccaaagccttctggagcgctatcgatgcgatcttcgctcagtcggccggcaacgggggcgggctgcctggcggcacattggactttcctgaactggaccaggctcgactggagaaatgtgcgaaagacaacgaacttattgactcagatatcaagttggacatcgacattgcacggtcgaagggcattacagcgaccccgaccctcgtcatccgggacaaccagacgggacgaagcgtgaagcttgaaggcatggccgacgagaccacgttgctgtcggcgatagactggctagccaaggatctctag

SEQ ID NO: 37 - protein, 232 aa, Pseudomonas aeruginosa
GRGPRGDPTAEASVRLLKGGWAAKRFQGPALPWAGLLLVLLAASAVGVELLVKGLPANHSLYGDAKARWTINEYADLECPFCKVYTPRLKRWVDSHPDVNLVWRHLPLQMHGEAARHQARLVECAGIQGGAKAFWSAIDAIFAQSAGNGGGLPGGTLDFPELDQARLEKCAKDNELIDSDIKLDIDIARSKGITATPTLVIRDNQTGRSVKLEGMADETTLLSAIDWLAKDL

SEQ ID NO: 38 - DNA, 333 bp, Pseudomonas aeruginosa
acctggtttggcgccatcttcccctgcagatgcatggcgaggcggcccgccaccaggctcgcctggtggagtgcgcggggatccaaggcggcgccaaagccttctggagcgctatcgatgcgatcttcgctcagtcggccggcaacgggggcgggctgcctggcggcacattggactttcctgaactggaccaggctcgactggagaaatgtgcgaaagacaacgaacttattgactcagatatcaagttggacatcgacattgcacggtcgaagggcattacagcgaccccgaccctcgtcatccgggacaaccagacgggacgaagcgtga

SEQ ID NO: 39 - protein, 110 aa, Pseudomonas aeruginosa
TWFGAIFPCRCMARRPATRLAWWSARGSKAAPKPSGALSMRSSLSRPATGAGCLAAHWTFLNWTRLDWRNVRKTTNLLTQISSWTSTLHGRRALQRPRPSSSGTTRRDEA

SEQ ID NO: 40 - DNA, 327 bp, Pseudomonas aeruginosa
gaaatcggcgaggattccaacatccctcttttggtcctccaggatgccctgcacttcacctggcagaacctcgacctcctccccatccacaatctttaccattctcttgtggccggagctggtgaggctaagcctcaactccattgccggccgagcattgatgtaaatgctctcgagcaagcgctccatgacttcgaccactccttaatatcagttagccagctacatacaggaattatgctacccaggacatgcaggcgtcacccctacttatgtacgtggcagcgttcgatcacggctcgaaaaaatacaccacctacgagttga

SEQ ID NO: 41 - protein, 108 aa, Pseudomonas aeruginosa
EIGEDSNIPLLVLQDALHFTWQNLDLLPIHNLYHSLVAGAGEAKPQLHCRPSIDVNALEQALHDFDHSLISVSQLHTGIMLPRTCRRHPYLCTWQRSITARKNTPPTS

SEQ ID NO: 42 - DNA, 303 bp, Pseudomonas aeruginosa
tttcctgctgccctatcggaagtgatcctgtctgctgtctgtacctttctagaaccggtacagacccatgcctcttcatcactccccccctggccggcggccaccaacgctggccgttggcgtactactggtactgctgagcagcgcgagtcaggccgaaacctgggtcatcaccgacaaggctcatccggtctctgccaccggatcgtcgcgcgttctgtttctggacgcccaggaacacctcgaggagcaactgactgcggccttgccccaggatccacagcatgctcaagcggcgtttaa

SEQ ID NO: 43 - protein, 100 aa, Pseudomonas aeruginosa
FPAALSEVILSAVCTFLEPVQTHASSSLPPWPAATNAGRWRTTGTAEQRESGRNLGHHRQGSSGLCHRIVARSVSGRPGTPRGATDCGLAPGSTACSSGV

SEQ ID NO: 44 - DNA, 447 bp, Pseudomonas aeruginosa
aaccggtacagacccatgcctcttcatcactccccccctggccggcggccaccaacgctggccgttggcgtactactggtactgctgagcagcgcgagtcaggccgaaacctgggtcatcaccgacaaggctcatccggtctctgccaccggatcgtcgcgcgttctgtttctggacgcccaggaacacctcgaggagcaactgactgcggccttgccccaggatccacagcatgctcaagcggcgtttaagcgattgctacaaagccccgatgggcgccgcctgcaggcagagctggtcaaggcacaacaagacgtcgccgatgcgtggagtctcggtgtcgagaagatccctgccgtagtagtcgataggcagtacgtggtctacggcgaaccggatgtttcgcgcgctcttgagctaatcgccaaggccaggaggtcgcgctga

SEQ ID NO: 45 - protein, 148 aa, Pseudomonas aeruginosa
NRYRPMPLHHSPPGRRPPTLAVGVLLVLLSSASQAETWVITDKAHPVSATGSSRVLFLDAQEHLEEQLTAALPQDPQHAQAAFKRLLQSPDGRRLQAELVKAQQDVADAWSLGVEKIPAVVVDRQYVVYGEPDVSRALELIAKARRSR

SEQ ID NO: 46 - DNA, 1017 bp, Pseudomonas aeruginosa
ttcgtctccgtgtccttattggaagtcggtactgcagatgaacatctgccccttgcgctggcagcaggagtagggacgccagagcgcccaggcgtgctccccgtcgacggcttgcgtcttcggcccagagttgggaaacaccgcgcagttgaggctcagggatggggtcagctcctgccatttcccggtcgaggcatcgccctctttcagctcgcccgccggccagtagccgtccttgggggctgcgcgcatggggaggtagacgtggagctggccgattcgcgtggtgatatcgccggcgcgctgggcgatgacggctgccgtcttgtagtcgtcggtctggtgcaggaagccgctgcgcggatagaggttcccccacatgtcgccggagaagattccacccacctcgcgcagccctgggaccaacgcttcggggtacacctgctcgggaattccatgccgccagccaatggcgtccagtgtgctgagaaagtacggcaccagcgggacggtggcgccagggcaaacgtacccagaggcgctggcgaaccggctgaacgtggcgccaccaggatggccgatcacatccgcttccttgaagcggccgatgctgttctcggccttgtagtttgtggtcgcgtcattgccggcctgggcgagtggattcggtgtacccagcgccgatacctcggtccaggggttgctcccggtattcgcgtagctggagacgactgcgtcaggcacgtagtggcggaccttgaccgacgtcttcactttgcagccatgcgggccgcagagcagccagtaacagatcccgacgaccttgtattcgaggcactgaggggaaagggtggaggagacgatggcagcgctgttgatcgcggccgaggccgtgaacgagaggctgaaggtggcggccgccgctgccaggcggcggaggttgaggctggtcatcagcgcgacctcctggccttggcgattagctcaagagcgcgcgaaacatccggttcgccgtag

SEQ ID NO: 47 - protein, 338 aa, Pseudomonas aeruginosa
FVSVSLLEVGTADEHLPLALAAGVGTPERPGVLPVDGLRLRPRVGKHRAVEAQGWGQLLPFPGRGIALFQLARRPVAVLGGCAHGEVDVELADSRGDIAGALGDDGCRLVVVGLVQEAAARIEVPPHVAGEDSTHLAQPWDQRFGVHLLGNSMPPANGVQCAEKVRHQRDGGARANVPRGAGEPAERGATRMADHIRFLEAADAVLGLVVCGRVIAGLGEWIRCTQRRYLGPGVAPGIRVAGDDCVRHVVADLDRRLHFAAMRAAEQPVTDPDDLVFEALRGKGGGDDGSAVDRGRGREREAEGGGRRCQAAEVEAGHQRDLLALAISSRARETSGSP

SEQ ID NO: 48 - DNA, 969 bp, Pseudomonas aeruginosa
gctaatcgccaaggccaggaggtcgcgctgatgaccagcctcaacctccgccgcctggcagcggcggccgccaccttcagcctctcgttcacggcctcggccgcgatcaacagcgctgccatcgtctcctccaccctttcccctcagtgcctcgaatacaaggtcgtcgggatctgttactggctgctctgcggcccgcatggctgcaaagtgaagacgtcggtcaaggtccgccactacgtgcctgacgcagtcgtctccagctacgcgaataccgggagcaacccctggaccgaggtatcggcgctgggtacaccgaatccactcgcccaggccggcaatgacgcgaccacaaactacaaggccgagaacagcatcggccgcttcaaggaagcggatgtgatcggccatcctggtggcgccacgttcagccggttcgccagcgcctctgggtacgtttgccctggcgccaccgtcccgctggtgccgtactttctcagcacactggacgccattggctggcggcatggaattcccgagcaggtgtaccccgaagcgttggtcccagggctgcgcgaggtgggtggaatcttctccggcgacatgtgggggaacctctatccgcgcagcggcttcctgcaccagaccgacgactacaagacggcagccgtcatcgcccagcgcgccggcgatatcaccacgcgaatcggccagctccacgtctacctccccatgcgcgcagcccccaaggacggctactggccggcgggcgagctgaaagagggcgatgcctcgaccgggaaatggcaggagctgaccccatccctgagcctcaactgcgcggtgtttcccaactctgggccgaagacgcaagccgtcgacggggagcacgcctgggcgctctggcgtccctactcctgctgccagcgcaaggggcagatgttcatctgcagtaccgacttccaataa

SEQ ID NO: 49 - protein, 322 aa, Pseudomonas aeruginosa
ANRQGQEVALMTSLNLRRLAAAAATFSLSFTASAAINSAAIVSSTLSPQCLEYKVVGICYWLLCGPHGCKVKTSVKVRHYVPDAVVSSYANTGSNPWTEVSALGTPNPLAQAGNDATTNYKAENSIGRFKEADVIGHPGGATFSRFASASGYVCPGATVPLVPYFLSTLDAIGWRHGIPEQVYPEALVPGLREVGGIFSGDMWGNLYPRSGFLHQTDDYKTAAVIAQRAGDITTRIGQLHVYLPMRAAPKDGYWPAGELKEGDASTGKWQELTPSLSLNCAVFPNSGPKTQAVDGEHAWALWRPYSCCQRKGQMFICSTDFQ

SEQ ID NO: 50 - DNA, 2025 bp, Pseudomonas aeruginosa
cgcgaccacaaactacaaggccgagaacagcatcggccgcttcaaggaagcggatgtgatcggccatcctggtggcgccacgttcagccggttcgccagcgcctctgggtacgtttgccctggcgccaccgtcccgctggtgccgtactttctcagcacactggacgccattggctggcggcatggaattcccgagcaggtgtaccccgaagcgttggtcccagggctgcgcgaggtgggtggaatcttctccggcgacatgtgggggaacctctatccgcgcagcggcttcctgcaccagaccgacgactacaagacggcagccgtcatcgcccagcgcgccggcgatatcaccacgcgaatcggccagctccacgtctacctccccatgcgcgcagcccccaaggacggctactggccggcgggcgagctgaaagagggcgatgcctcgaccgggaaatggcaggagctgaccccatccctgagcctcaactgcgcggtgtttcccaactctgggccgaagacgcaagccgtcgacggggagcacgcctgggcgctctggcgtccctactcctgctgccagcgcaaggggcagatgttcatctgcagtaccgacttccaataaggacacggagacgaatcatgcgaatgaacatcacctcggtcgcgctaatgtggctgctcgcagcgcaacttgcccaggccgacgacccgatcaacgtgtccaagaccggcacggtgctcagcgacgaggtcctctacagcattggcggcggcagtgcggtgagcatgggcagcgccggccagatggactcgatcggcgtcggcttcggctggaacaacgacatgatgtgcggaaacatgaacctgagcaccaccctggagaaccagctcaacggtgccacacagggtttccagaacatcatgggctcagtcatccagaacgcgaccggcgcggtcatgtcgctgccggcgttgatcatccagcgcgcgaaccctcagctctacaacctgatcaccaatggcatcctgcaggcgcggatcgactacgaccgctcgaaagggacttgcaaaacgatcgccgaaaagatggctgacatcgctggcgagcagaccggctgggggaaaatcgccgaaggccaagccctgggcgccacactggcctctgacgggaaagacgccgtatccgccctcgaagcagtggagaagaaaggcggcaacgatggcgtaacctgggttggtggagacaaggccggcggctccggccagaagcccattcgcatcgtcaacgacgtgacccgggcgggctacaacctgttgaccagccgctcggtgaatgattcgtcgagcgtgccttccgccacttgcaacaacggcctggtctgcaacacttggtcctccccccaggaggccgccgcattcgccacccgggtactgggggagcaacagcaacagacctgcgaaggctgccagaagacggtgacggctgctggcgtcggcctcaccccgctgatccaggagacctacgacaagaagctccagtcgctgcaggagctgctgtcgaagagcaaaccactgactgcagagaacctggctgcggccggcaccgatgctctgccaattacccgcggcgtcatcgaggcgctgcgcgacgagcgtgaccaggacgtcctggcgcgccgcctggcgtccgatgtctccctgatggacgtgctcagcaaggcactgctactgcagcgcctgatgttcgccggcgccaaggagcccaacgtcgccgccaacggcctggccacccaagccgtcgatcagcagaccagcctcctgcagcaggagatctccaatctcaagaccgaactggaactccgtcgcgagttggccagcaactcccccatgcgggtcatcgagcgcgggcaacaacgcgcctcagggtccagtggcgtgttcgagtcggcgcccgatgccgatcgcctcgatcgcctgcaggccccctctgccgccggcggcaagtcgggagggagaccgtga

SEQ ID NO: 51 - protein, 674 aa, Pseudomonas aeruginosa
RDHKLQGREQHRPLQGSGCDRPSWWRHVQPVRQRLWVRLPWRHRPAGAVLSQHTGRHWLAAWNSRAGVPRSVGPRAARGGWNLLRRHVGEPLSAQRLPAPDRRLQDGSRHRPARRRYHHANRPAPRLPPHARSPQGRLLAGGRAERGRCLDREMAGADPIPEPQLRGVSQLWAEDASRRRGARLGALASLLLLPAQGADVHLQYRLPIRTRRRIMRMNITSVALMWLLAAQLAQADDPINVSKTGTVLSDEVLYSIGGGSAVSMGSAGQMDSIGVGFGWNNDMMCGNMNLSTTLENQLNGATQGFQNIMGSVIQNATGAVMSLPALIIQRANPQLYNLITNGILQARIDYDRSKGTCKTIAEKMADIAGEQTGWGKIAEGQALGATLASDGKDAVSALEAVEKKGGNDGVTWVGGDKAGGSGQKPIRIVNDVTRAGYNLLTSRSVNDSSSVPSATCNNGLVCNTWSSPQEAAAFATRVLGEQQQQTCEGCQKTVTAAGVGLTPLIQETYDKKLQSLQELLSKSKPLTAENLAAAGTDALPITRGVIEALRDERDQDVLARRLASDVSLMDVLSKALLLQRLMFAGAKEPNVAANGLATQAVDQQTSLLQQEISNLKTELELRRELASNSPMRVIERGQQRASGSSGVFESAPDADRLDRLQAPSAAGGKSGGRP

SEQ ID NO: 52 - DNA, 375 bp, Pseudomonas aeruginosa
tcggccatcctggtggcgccacgttcagccggttcgccagcgcctctgggtacgtttgccctggcgccaccgtcccgctggtgccgtactttctcagcacactggacgccattggctggcggcatggaattcccgagcaggtgtaccccgaagcgttggtcccagggctgcgcgaggtgggtggaatcttctccggcgacatgtgggggaacctctatccgcgcagcggcttcctgcaccagaccgacgactacaagacggcagccgtcatcgcccagcgcgccggcgatatcaccacgcgaatcggccagctccacgtctacctccccatgcgcgcagcccccaaggacggctactggccggcgggcgagctga

SEQ ID NO: 53 - protein, 124 aa, Pseudomonas aeruginosa
SAILVAPRSAGSPAPLGTFALAPPSRWCRTFSAHWTPLAGGMEFPSRCTPKRWSQGCARWVESSPATCGGTSIRAAASCTRPTTTRRQPSSPSAPAISPRESASSTSTSPCAQPPRTATGRRAS

SEQ ID NO: 54 - DNA, 612 bp, Pseudomonas aeruginosa
gcctcaactgcgcggtgtttcccaactctgggccgaagacgcaagccgtcgacggggagcacgcctgggcgctctggcgtccctactcctgctgccagcgcaaggggcagatgttcatctgcagtaccgacttccaataaggacacggagacgaatcatgcgaatgaacatcacctcggtcgcgctaatgtggctgctcgcagcgcaacttgcccaggccgacgacccgatcaacgtgtccaagaccggcacggtgctcagcgacgaggtcctctacagcattggcggcggcagtgcggtgagcatgggcagcgccggccagatggactcgatcggcgtcggcttcggctggaacaacgacatgatgtgcggaaacatgaacctgagcaccaccctggagaaccagctcaacggtgccacacagggtttccagaacatcatgggctcagtcatccagaacgcgaccggcgcggtcatgtcgctgccggcgttgatcatccagcgcgcgaaccctcagctctacaacctgatcaccaatggcatcctgcaggcgcggatcgactacgaccgctcgaaagggacttgcaaaacgatcgccgaaaagatggctga

SEQ ID NO: 55 - protein, 203 aa, Pseudomonas aeruginosa
ASTARCFPTLGRRRKPSTGSTPGRSGVPTPAASARGRCSSAVPTSNKDTETNHANEHHLGRANVAARSATCPGRRPDQRVQDRHGAQRRGPLQHWRRQCGEHGQRRPDGLDRRRLRLEQRHDVRKHEPEHHPGEPAQRCHTGFPEHHGLSHPERDRRGHVAAGVDHPAREPSALQPDHQWHPAGADRLRPLERDLQNDRRKDG

SEQ ID NO: 56 - DNA, 798 bp, Pseudomonas aeruginosa
cagtgccttgctgagcacgtccatcagggagacatcggacgccaggcggcgcgccaggacgtcctggtcacgctcgtcgcgcagcgcctcgatgacgccgcgggtaattggcagagcatcggtgccggccgcagccaggttctctgcagtcagtggtttgctcttcgacagcagctcctgcagcgactggagcttcttgtcgtaggtctcctggatcagcggggtgaggccgacgccagcagccgtcaccgtcttctggcagccttcgcaggtctgttgctgttgctcccccagtacccgggtggcgaatgcggcggcctcctggggggaggaccaagtgttgcagaccaggccgttgttgcaagtggcggaaggcacgctcgacgaatcattcaccgagcggctggtcaacaggttgtagcccgcccgggtcacgtcgttgacgatgcgaatgggcttctggccggagccgccggccttgtctccaccaacccaggttacgccatcgttgccgcctttcttctccactgcttcgagggcggatacggcgtctttcccgtcagaggccagtgtggcgcccagggcttggccttcggcgattttcccccagccggtctgctcgccagcgatgtcagccatcttttcggcgatcgttttgcaagtccctttcgagcggtcgtagtcgatccgcgcctgcaggatgccattggtgatcaggttgtagagctgagggttcgcgcgctggatgatcaacgccggcagcgacatgaccgcgccggtcgcgttctggatgactga

SEQ ID NO: 57 - protein, 265 aa, Pseudomonas aeruginosa
QCLAEHVHQGDIGRQAARQDVLVTLVAQRLDDAAGNWQSIGAGRSQVLCSQWFALRQQLLQRLELLVVGLLDQRGEADASSRHRLLAAFAGLLLLLPQYPGGECGGLLGGGPSVADQAVVASGGRHARRIIHRAAGQQVVARPGHVVDDANGLLAGAAGLVSTNPGYAIVAAFLLHCFEGGYGVFPVRGQCGAQGLAFGDFPPAGLLASDVSHLFGDRFASPFRAVVVDPRLQDAIGDQVVELRVRALDDQRRQRHDRAGRVLDD

SEQ ID NO: 58 - DNA, 321 bp, Pseudomonas aeruginosa
ttcgtcgagcgtgccttccgccacttgcaacaacggcctggtctgcaacacttggtcctccccccaggaggccgccgcattcgccacccgggtactgggggagcaacagcaacagacctgcgaaggctgccagaagacggtgacggctgctggcgtcggcctcaccccgctgatccaggagacctacgacaagaagctccagtcgctgcaggagctgctgtcgaagagcaaaccactgactgcagagaacctggctgcggccggcaccgatgctctgccaattacccgcggcgtcatcgaggcgctgcgcgacgagcgtga

SEQ ID NO: 59 - protein, 106 aa, Pseudomonas aeruginosa
FVERAFRHLQQRPGLQHLVLPPGGRRIRHPGTGGATATDLRRLPEDGDGCWRRPHPADPGDLRQEAPVAAGAAVEEQTTDCREPGCGRHRCSANYPRRHRGAARRA

SEQ ID NO: 60 - DNA, 705 bp, Pseudomonas aeruginosa
ccaggacgtcctggcgcgccgcctggcgtccgatgtctccctgatggacgtgctcagcaaggcactgctactgcagcgcctgatgttcgccggcgccaaggagcccaacgtcgccgccaacggcctggccacccaagccgtcgatcagcagaccagcctcctgcagcaggagatctccaatctcaagaccgaactggaactccgtcgcgagttggccagcaactcccccatgcgggtcatcgagcgcgggcaacaacgcgcctcagggtccagtggcgtgttcgagtcggcgcccgatgccgatcgcctcgatcgcctgcaggccccctctgccgccggcggcaagtcgggagggagaccgtgatggcagatacgctcaccacccgaaagcttctcggtcagctactggtcggagtgctgatcgtcatcggactggcagtggtcggtacgctgctcagtctcttcgccctgaaccacttcggtggcatccagggcctggaggcctggcggcaaagcaactactggagcttgttcgcctggcgggcgctgctgtactgcgccctggccatcgcctggttccggcagcgcaaggaactgagcgcgcatgagcggcagcgcattcggcggatcgagatcctggtgctgttgctggtcctgctcatcgaattcagcaaagcctacttccgcacgggaggcgcagcatga

SEQ ID NO: 61 - protein, 234 aa, Pseudomonas aeruginosa
PGRPGAPPGVRCLPDGRAQQGTATAAPDVRRRQGAQRRRQRPGHPSRRSADQPPAAGDLQSQDRTGTPSRVGQQLPHAGHRARATTRLRVQWRVRVGARCRSPRSPAGPLCRRRQVGRETVMADTLTTRKLLGQLLVGVLIVIGLAVVGTLLSLFALNHFGGIQGLEAWRQSNYWSLFAWRALLYCALAIAWFRQRKELSAHERQRIRRIEILVLLLVLLIEFSKAYFRTGGAA

SEQ ID NO: 62 - DNA, 525 bp, Pseudomonas aeruginosa
tgttcgccggcgccaaggagcccaacgtcgccgccaacggcctggccacccaagccgtcgatcagcagaccagcctcctgcagcaggagatctccaatctcaagaccgaactggaactccgtcgcgagttggccagcaactcccccatgcgggtcatcgagcgcgggcaacaacgcgcctcagggtccagtggcgtgttcgagtcggcgcccgatgccgatcgcctcgatcgcctgcaggccccctctgccgccggcggcaagtcgggagggagaccgtgatggcagatacgctcaccacccgaaagcttctcggtcagctactggtcggagtgctgatcgtcatcggactggcagtggtcggtacgctgctcagtctcttcgccctgaaccacttcggtggcatccagggcctggaggcctggcggcaaagcaactactggagcttgttcgcctggcgggcgctgctgtactgcgccctggccatcgcctggttccggcagcgcaaggaactgagcgcgcatga

SEQ ID NO: 63 - protein, 174 aa, Pseudomonas aeruginosa
CSPAPRSPTSPPTAWPPKPSISRPASCSRRSPISRPNWNSVASWPATPPCGSSSAGNNAPQGPVACSSRRPMPIASIACRPPLPPAASREGDRDGRYAHHPKASRSATGRSADRHRTGSGRYAAQSLRPEPLRWHPGPGGLAAKQLLELVRLAGAAVLRPGHRLVPAAQGTERA

SEQ ID NO: 64 - DNA, 306 bp, Pseudomonas aeruginosa
aggtcatgctgcgcctcccgtgcggaagtaggctttgctgaattcgatgagcaggaccagcaacagcaccaggatctcgatccgccgaatgcgctgccgctcatgcgcgctcagttccttgcgctgccggaaccaggcgatggccagggcgcagtacagcagcgcccgccaggcgaacaagctccagtagttgctttgccgccaggcctccaggccctggatgccaccgaagtggttcagggcgaagagactgagcagcgtaccgaccactgccagtccgatgacgatcagcactccgaccagtag

SEQ ID NO: 65 - protein, 101 aa, Pseudomonas aeruginosa
RSCCASRAEVGFAEFDEQDQQQHQDLDPPNALPLMRAQFLALPEPGDGQGAVQQRPPGEQAPVVALPPGLQALDATEVVQGEETEQRTDHCQSDDDQHSDQ

SEQ ID NO: 66 - DNA, 1605 bp, Pseudomonas aeruginosa
gcggcagcgcattcggcggatcgagatcctggtgctgttgctggtcctgctcatcgaattcagcaaagcctacttccgcacgggaggcgcagcatgaccttcatgaccaatgactacctggagtattacctcaccctcctcggctggatcatcaacaacgggatctggaacatgatctcggatactggcctgttcgcggtgccgttcgcggccatcgtgatgcgcgaatggctgaaagttcgtggggaaggcgccgacgagggcaacaagggagtgctgtctctcgcccgcatcgagacgcatatctacgtcggctacatcgtggtcgccctggcggggatcccggtcgtcaacgtgagcttcgacaccatcgagttcgaccagactcgcgcccagcagtgccaatacaatctgccggcaccggcggacaccggctggtcgagctccttcagcagcctggccggcaagagtgcgcagatgccgctctggtgggcgatgatgcacgccctgtccaagggcttcaccagcggcgccatcgcggccattccgtgcggcacggatctgcggcagatgcgaatggaagtggacaacacgcgcgtgaacaatccgctgctggcacaagaaatcgctgatttttccagagactgctacgggccttcccgtgcgcggctgttcatgcggcaacccgacctgggctccgtcgccgaggacaacaaggcgttgcaagacctgaactggatcggctcccgattcttgttgaacaccccggggtactacgacaccgactactcgaagagtccccgtcagtcgtggccctacaacgccacccgcgatgccggcctgcctcaggtgggcggtggtggcggctacccaacctgcaagcagtggtgggctgactcagggatcggcttgcgtgatcggatcaaggaccaggtggatccggacctgatgaccagcttcctcaagtgggcgaaatggttgaaccaggacgaggtgaccgaggctgtcattcgccaggtgatctcaccctccagccaggtcaagggtaacgtctacaccgattacggcgggcaggtgggcggcaccgtgtggaacggcatcgcgagaaccgcaggaaccttcggcgttgcggtgggcagcttggcatacttcccggcgatggatatggtccgccaggcactgccgatggtgatgtcgttcctgaagatggcaatggtcatctgcattccgatggtcctggtcatcggcacctatcaactgaaagttgccatgacgatgacggtcgtcttctttgcgatgatgttcgtcgacttctggtttcagttagccagatatatcgacagcacgatacttgatgctttctatggttcgggatcaccacatctttcattcaacccagtcatggggctgaatacggctactcaagatgcgatcttgaacttcgttatgggttctatgttcattgttttaccactactgtggatgacagcgatcggctggtccggaattcaagcagggtctgttctgaacggattgagcagagggactgaaggagttcaagccgccggcaaggaagcaggaaatagagttaaaaacgcagtttga

SEQ ID NO: 67 - protein, 534 aa, Pseudomonas aeruginosa
AAAHSADRDPGAVAGPAHRIQQSLLPHGRRSMTFMTNDYLEYYLTLLGWIINNGIWNMISDTGLFAVPFAAIVMREWLKVRGEGADEGNKGVLSLARIETHIYVGYIVVALAGIPVVNVSFDTIEFDQTRAQQCQYNLPAPADTGWSSSFSSLAGKSAQMPLWWAMMHALSKGFTSGAIAAIPCGTDLRQMRMEVDNTRVNNPLLAQEIADFSRDCYGPSRARLFMRQPDLGSVAEDNKALQDLNWIGSRFLLNTPGYYDTDYSKSPRQSWPYNATRDAGLPQVGGGGGYPTCKQWWADSGIGLRDRIKDQVDPDLMTSFLKWAKWLNQDEVTEAVIRQVISPSSQVKGNVYTDYGGQVGGTVWNGIARTAGTFGVAVGSLAYFPAMDMVRQALPMVMSFLKMAMVICIPMVLVIGTYQLKVAMTMTVVFFAMMFVDFWFQLARYIDSTILDAFYGSGSPHLSFNPVMGLNTATQDAILNFVMGSMFIVLPLLWMTAIGWSGIQAGSVLNGLSRGTEGVQAAGKEAGNRVKNAV

SEQ ID NO: 68 - DNA, 828 bp, Pseudomonas aeruginosa
gtcagcccaccactgcttgcaggttgggtagccgccaccaccgcccacctgaggcaggccggcatcgcgggtggcgttgtagggccacgactgacggggactcttcgagtagtcggtgtcgtagtaccccggggtgttcaacaagaatcgggagccgatccagttcaggtcttgcaacgccttgttgtcctcggcgacggagcccaggtcgggttgccgcatgaacagccgcgcacgggaaggcccgtagcagtctctggaaaaatcagcgatttcttgtgccagcagcggattgttcacgcgcgtgttgtccacttccattcgcatctgccgcagatccgtgccgcacggaatggccgcgatggcgccgctggtgaagcccttggacagggcgtgcatcatcgcccaccagagcggcatctgcgcactcttgccggccaggctgctgaaggagctcgaccagccggtgtccgccggtgccggcagattgtattggcactgctgggcgcgagtctggtcgaactcgatggtgtcgaagctcacgttgacgaccgggatccccgccagggcgaccacgatgtagccgacgtagatatgcgtctcgatgcgggcgagagacagcactcccttgttgccctcgtcggcgccttccccacgaactttcagccattcgcgcatcacgatggccgcgaacggcaccgcgaacaggccagtatccgagatcatgttccagatcccgttgttgatgatccagccgaggagggtgaggtaatactccaggtagtcattggtcatgaaggtcatgctgcgcctcccgtgcggaagtag

SEQ ID NO: 69 - protein, 275 aa, Pseudomonas aeruginosa
VSPPLLAGWVAATTAHLRQAGIAGGVVGPRLTGTLRVVGVVVPRGVQQESGADPVQVLQRLVVLGDGAQVGLPHEQPRTGRPVAVSGKISDFLCQQRIVHARVVHFHSHLPQIRAARNGRDGAAGEALGQGVHHRPPERHLRTLAGQAAEGARPAGVRRCRQIVLALLGASLVELDGVEAHVDDRDPRQGDHDVADVDMRLDAGERQHSLVALVGAFPTNFQPFAHHDGRERHREQASIRDHVPDPVVDDPAEEGEVILQVVIGHEGHAAPPVRK

SEQ ID NO: 70 - DNA, 519 bp, Pseudomonas aeruginosa
ctacctggagtattacctcaccctcctcggctggatcatcaacaacgggatctggaacatgatctcggatactggcctgttcgcggtgccgttcgcggccatcgtgatgcgcgaatggctgaaagttcgtggggaaggcgccgacgagggcaacaagggagtgctgtctctcgcccgcatcgagacgcatatctacgtcggctacatcgtggtcgccctggcggggatcccggtcgtcaacgtgagcttcgacaccatcgagttcgaccagactcgcgcccagcagtgccaatacaatctgccggcaccggcggacaccggctggtcgagctccttcagcagcctggccggcaagagtgcgcagatgccgctctggtgggcgatgatgcacgccctgtccaagggcttcaccagcggcgccatcgcggccattccgtgcggcacggatctgcggcagatgcgaatggaagtggacaacacgcgcgtgaacaatccgctgctggcacaagaaatcgctga

SEQ ID NO: 71 - protein, 172 aa, Pseudomonas aeruginosa
LPGVLPHPPRLDHQQRDLEHDLGYWPVRGAVRGHRDARMAESSWGRRRRGQQGSAVSRPHRDAYLRRLHRGRPGGDPGRQRELRHHRVRPDSRPAVPIQSAGTGGHRLVELLQQPGRQECADAALVGDDARPVQGLHQRRHRGHSVRHGSAADANGSGQHAREQSAAGTRNR

SEQ ID NO: 72 - DNA, 333 bp, Pseudomonas aeruginosa
cagtctctggaaaaatcagcgatttcttgtgccagcagcggattgttcacgcgcgtgttgtccacttccattcgcatctgccgcagatccgtgccgcacggaatggccgcgatggcgccgctggtgaagcccttggacagggcgtgcatcatcgcccaccagagcggcatctgcgcactcttgccggccaggctgctgaaggagctcgaccagccggtgtccgccggtgccggcagattgtattggcactgctgggcgcgagtctggtcgaactcgatggtgtcgaagctcacgttgacgaccgggatccccgccagggcgaccacgatgtag

SEQ ID NO: 73 - protein, 110 aa, Pseudomonas aeruginosa
QSLEKSAISCASSGLFTRVLSTSIRICRRSVPHGMAAMAPLVKPLDRACIIAHQSGICALLPARLLKELDQPVSAGAGRLYWHCWARVWSNSMVSKLTLTTGIPARATTM

SEQ ID NO: 74 - DNA, 300 bp, Pseudomonas aeruginosa
ctgaaaccagaagtcgacgaacatcatcgcaaagaagacgaccgtcatcgtcatggcaactttcagttgataggtgccgatgaccaggaccatcggaatgcagatgaccattgccatcttcaggaacgacatcaccatcggcagtgcctggcggaccatatccatcgccgggaagtatgccaagctgcccaccgcaacgccgaaggttcctgcggttctcgcgatgccgttccacacggtgccgcccacctgcccgccgtaatcggtgtagacgttacccttgacctggctggagggtga

SEQ ID NO: 75 - protein, 99 aa, Pseudomonas aeruginosa
LKPEVDEHHRKEDDRHRHGNFQLIGADDQDHRNADDHCHLQERHHHRQCLADHIHRREVCQAAHRNAEGSCGSRDAVPHGAAHLPAVIGVDVTLDLAGG

SEQ ID NO: 76 - DNA, 306 bp, Pseudomonas aeruginosa
cgtctacaccgattacggcgggcaggtgggcggcaccgtgtggaacggcatcgcgagaaccgcaggaaccttcggcgttgcggtgggcagcttggcatacttcccggcgatggatatggtccgccaggcactgccgatggtgatgtcgttcctgaagatggcaatggtcatctgcattccgatggtcctggtcatcggcacctatcaactgaaagttgccatgacgatgacggtcgtcttctttgcgatgatgttcgtcgacttctggtttcagttagccagatatatcgacagcacgatacttga

SEQ ID NO: 77 - protein, 101 aa, Pseudomonas aeruginosa
RLHRLRRAGGRHRVERHRENRRNLRRCGGQLGILPGDGYGPPGTADGDVVPEDGNGHLHSDGPGHRHLSTESCHDDDGRLLCDDVRRLLVSVSQIYRQHDT

SEQ ID NO: 78 - DNA, 387 bp, Pseudomonas aeruginosa
gtgatagcaggatgcctccctttgggagccaggagattgatgatgaacgcgcacaccaacaaaggctttgcctcccggatcggttttggtctgggtatgcttgtgcgtttctgcctgcatgatcgccgtccagctctacgttgggttaagcgagttagcctattcttgttagtagctcttgtagtgtcacagaattttatgtggcttgctggggtatcaatgactctactgtgtgtctttctggtgggatttgccttggttaaaggggacatctccgtctctaaagggtctccaagtcgagatgtctcaactatgacttcacaagctgaaactgaatctgtagcagagctgtttgactatcaggcagcacaccattaccgggactag

SEQ ID NO: 79 - protein, 128 aa, Pseudomonas aeruginosa
VIAGCLPLGARRLMMNAHTNKGFASRIGFGLGMLVRFCLHDRRPALRWVKRVSLFLLVALVVSQNFMWLAGVSMTLLCVFLVGFALVKGDISVSKGSPSRDVSTMTSQAETESVAELFDYQAAHHYRD

SEQ ID NO: 80 - DNA, 705 bp, Pseudomonas aeruginosa
  variation (1)...(705): N is any nucleic acid.
tcaaacagctctgctacagattcagtttcagcttgtgaagtcatagttgagacatctcgacttggagaccctttagagacggagatgtcccctttaaccaaggcaaatcccaccagaaagacacacagtagagtcattgataccccagcaagccacataaaattctgtgacactacaagagctactaacaagaataggctaactcgcttaacccaacgtagagctggacggcgatcatgcaggcagaaacgcacaagcatacccagaccaaaaccgatccgggaggcaaagcctttgttggtgtgcgcgttcatcatcaatctcctggctcccaaagggaggcatcctgctatcacctatacgccgaaaaagatgatttggcaagcattatggcatattatgccactagctatctgccgactggagtacctcatggcaacgcgaaacgtcgtccttcccgatccgctggagcaggatatcaacgagctggtggagaccggccgctatcagaatcgcagcgaagtcatccgggcaggcttgcgcctgctgctgcaacaggaagcccagatangcgccaagctcgaaaccctccgcaacgcaacatccagtgggctgatgcaactggagcgcggcgagtacgacgagatcaccagcgacgaactggcccaatacctcgacgagctcggcaaccaggcgagccactga

SEQ ID NO: 81 - protein, 233 aa, Pseudomonas aeruginosa
SNSSATDSVSACEVIVETSRLGDPLETEMSPLTKANPTRKTHSRVIDTPASHIKFCDTTRATNKNRLTRLTQRRAGRRSCRQKRTSIPRPKPIREAKPLLVCAFIINLLAPKGRHPAITYTPKKMIWQALWHIMPLAICRLEYLMATRNVVLPDPLEQDINELVETGRYQNRSEVIRAGLRLLLQQEAQIAKLETLRNATSSGLMQLERGEYDEITSDELAQYLDELGNQASH

SEQ ID NO: 82 - DNA, 513 bp, Pseudomonas aeruginosa
  variation (1)...(513): N is any nucleic acid.
agctggacggcgatcatgcaggcagaaacgcacaagcatacccagaccaaaaccgatccgggaggcaaagcctttgttggtgtgcgcgttcatcatcaatctcctggctcccaaagggaggcatcctgctatcacctatacgccgaaaaagatgatttggcaagcattatggcatattatgccactagctatctgccgactggagtacctcatggcaacgcgaaacgtcgtccttcccgatccgctggagcaggatatcaacgagctggtggagaccggccgctatcagaatcgcagcgaagtcatccgggcaggcttgcgcctgctgctgcaacaggaagcccagatangcgccaagctcgaaaccctccgcaacgcaacatccagtgggctgatgcaactggagcgcggcgagtacgacgagatcaccagcgacgaactggcccaatacctcgacgagctcggcaaccaggcgagccactgaagcatggccaagtaccgcatctctcatga

SEQ ID NO: 83 - protein, 169 aa, Pseudomonas aeruginosa
SWTAIMQAETHKHTQTKTDPGGKAFVGVRVHHQSPGSQREASCYHLYAEKDDLASIMAYYATSYLPTGVPHGNAKRRPSRSAGAGYQRAGGDRPLSESQRSHPGRLAPAAATGSPDRQARNPPQRNIQWADATGARRVRRDHQRRTGPIPRRARQPGEPLKHGQVPHLS

SEQ ID NO: 84 - DNA, 591 bp, Pseudomonas aeruginosa
  variation (1)...(591): N is any nucleic acid.
cacctggtctgtcgccacccggtagaagacgaagtgcctgggccgaacaaccttaccgacattgggcatcgagtggcagtaaacgaggtggatgctgcgcaggccagctcccagttcttcacggctgatgctgcctacctgttgtgggtctgtcgcaactgcttccagcgccgcccctatgagtgcctggtaacgtcggcgcgcggcatcgccgaagtggttgtgggtgaagcgcaggatatcgacgatgtccgcttgggcatcatgagagatgcggtacttggccatgcttcagtggctcgcctggttgccgagctcgtcgaggtattgggccagttcgtcgctggtgatctcgtcgtactcgccgcgctccagttgcatcagcccactggatgttgcgttgcggagggtttcgagcttggcgcntatctgggcttcctgttgcagcagcaggcgcaagcctgcccggatgacttcgctgcgattctgatagcggccggtctccaccagctcgttgatatcctgctccagcggatcgggaaggacgacgtttcgcgttgccatgaggtactccagtcggcagatagctag

SEQ ID NO: 85 - protein, 195 aa, Pseudomonas aeruginosa
HLVCRHPVEDEVPGPNNLTDIGHRVAVNEVDAAQASSQFFTADAAYLLWVCRNCFQRRPYECLVTSARGIAEVVVGEAQDIDDVRLGIMRDAVLGHASVARLVAELVEVLGQFVAGDLVVLAALQLHQPTGCCVAEGFELGYLGFLLQQQAQACPDDFAAILIAAGLHQLVDILLQRIGKDDVSRCHEVLQSADS

SEQ ID NO: 86 - DNA, 354 bp, Pseudomonas aeruginosa
agcatggccaagtaccgcatctctcatgatgcccaagcggacatcgtcgatatcctgcgcttcacccacaaccacttcggcgatgccgcgcgccgacgttaccaggcactcataggggcggcgctggaagcagttgcgacagacccacaacaggtaggcagcatcagccgtgaagaactgggagctggcctgcgcagcatccacctcgtttactgccactcgatgcccaatgtcggtaaggttgttcggcccaggcacttcgtcttctaccgggtggcgacagaccaggtgctagaggtggttcgcgtgcttcacgacgccatggatgtggatcaacacctgccccaacgatga

SEQ ID NO: 87 - protein, 117 aa, Pseudomonas aeruginosa
SMAKYRISHDAQADIVDILRFTHNHFGDAARRRYQALIGAALEAVATDPQQVGSISREELGAGLRSIHLVYCHSMPNVGKVVRPRHFVFYRVATDQVLEVVRVLHDAMDVDQHLPQR

SEQ ID NO: 88 - DNA, 330 bp, Pseudomonas aeruginosa
agccgcatgcaagcggtggtcagcacgaatgcaaatgcttggtcagggggaatgcaatcgagtggtcaagccactgctattgcgcatcaaccatggggcacctgctggtggatgttcacccgtagccttttcgtgttcgccggcgcgaacgcagccctttctgccttccggcaggccctttcgggtagggcttttacccttgtgaaccattcccttcgcccttcaagcccatttcccctttgggccatttgctcctgttacagttgctcatcgttggggcaggtgttgatccacatccatggcgtcgtgaagcacgcgaaccacctctag

SEQ ID NO: 89 - protein, 109 aa, Pseudomonas aeruginosa
SRMQAVVSTNANAWSGGMQSSGQATAIAHQPWGTCWWMFTRSLFVFAGANAALSAFRQALSGRAFTLVNHSLRPSSPFPLWAICSCYSCSSLGQVLIHIHGVVKHANHL

SEQ ID NO: 90 - DNA, 309 bp, Pseudomonas aeruginosa
accgcggtgcggagagatctcctcaaactgatgggttgcacgcatatcgaagcagattacataggaggcttgcgctgttcaacagctcctgaggggacttgggttgcccatggtttccacggcccaatcgttgacgtcattgacgattccgctggctttttcagtacgcatcgcttggcgctccattacccagcccaatgcggccttgccgttgaccaagcgattccaaggactgcgatccatgtagccagccctctaatgcatgtatgtataggtaaggtcgtcgttatttcggcgtggatgtgctga

SEQ ID NO: 91 - protein, 102 aa, Pseudomonas aeruginosa
TAVRRDLLKLMGCTHIEADYIGGLRCSTAPEGTWVAHGFHGPIVDVIDDSAGFFSTHRLALHYPAQCGLAVDQAIPRTAIHVASPLMHVCIGKVVVISAWMC

SEQ ID NO: 92 - DNA, 2436 bp, Pseudomonas aeruginosa
gaagaggtgatcatgaagttacaggcatatcggctgcagaactaccgccggctgcgcgatgttgtcatcgagctcgatgacgaaatttctatctttgtcggtgccaacaacagcgggaagacatccgccgtccaaggcctgtactcaatgcttcgcggcgaagtgaagaagttcgagctctttgacttcagtgcggcgctgtgggccgagatcgatgcggtcggcaggacgccccctggcgatgaggatgcgcccaaaaggttaccgtccatactcttggatctctggttccgcgtcggtgaagacgacctcgccactgcgatgtcgctgctgccgagcactgagtgggacggcaagtgcgtcgggatccgggtagcgttcgagcctcgggatgcccacgagctcgtctggaagttccatgaactacatgagaaggccaacaacgcagctgtcgcgcttgcggccaagcgcaaggccgccggggagcaagctgtggaggcgggcgcggaagacgcggctgcggtggtggccgatgccggcgagtacaagccttggccagaaagcctgacgaagtacctcacaaaggaactgagcaaggaatacaccttccgctactacgtgctcgatgagcgggcttttgtcggctatcaggcaagggaggccgactacgagccgctacccctaggcaaggagccgggcggtgcagccattctcaagtcgctggtgagggtcgacttcctgcgcgcgcagcggcacctcgatgacccagatgccggtagctctgatcgcgcagagagcttgtcgcggcgtctgagcaggttctatcaccgcaacctggagaagcgtggcgacgaccatgcggctctcaaggcgctagatacctcggagaaggagctgaacttccacctgaaggaagtcttcaatgacaccctcacgcgcctggccaagctcggctatccgggcgtcaacaatccggagatcgtgattcgggcggccttggatccgaccactgtcttggggcaagacgccaaggttcactacgtgatcccgggcgtagcttccgcccaactgccagacagctacaatggcctggggttcaagaatctggtctacatggtggttgagctgctcgacttgcacgagcagtggaaagccgaggatgacaagcgagctccgcttcatttggtcttcattgaggagcctgaggcgcatctgcacgcgcagatccagcaggtcttcatcaggaacgttttgcgcctccttgaggatgctaacgatcacgcgactttgttccacacgcagctcgtcatcaccacgcactccccgcacatcctctatgaacgcggattctcgcccattcggtacttccgccgcgtcaacgaccagttgggccatcacacggatgtgcgcaatctgtcgctattcaaaacgggcgcgtccgacgctccagcgcgcgaattcctgcagcggtatctgaagctgacgcactgcgatctctttttttccgacgcggtgatattggtggaaggcaacgtcgagcgtctgctcctgcctgcaatgatcgagttggtggccaagcgcctgcgttcttccgccctaaccatccttgaagtcggtggtgcgttcgcgcatcggttccaggagctgatcgccttcgttgggctcacaacactggtcatcacggatctggacagcgtgacggtcaagacggacgccgagaaggccgccgcgcaaggcgcaggcgctgagggcgccgttgacggagatgacgaggacgaggacgacgacctgaagcccttcgagcttgaagacgacgacgaagcagaaccgagtggcaagaagaagtccaagaagcgtggcagcacctgccatgcacacgtggaaggtgccgtcacgtccaaccaaaccctcatcagctggatcccgaagaagcggtcgatggcagagctctgggaagtcacggcggagcaaaagacgctgtcgctggctgaggattccagcgctggggttcgggtagcttaccagaccaaggtttcggtgacggtgggtgcgacgacatcacagctctgcggccgcacacttgaggaggcctttggtcttgagaacgcggactggtgccaggctgaggcaaaccggtcggtcggcctcaagctcaagcgcgcaccgagcagccctgaagagctggctgagaagttacacgatagggtggtcggcaagaacttcgacaagacccgctttgcgctggaggtactcgcaagcgggccgctcaatggctggaaggttcccgcgtacatcgccgagggcttggcctggctcgaagccaaagtggcccacgagcttgaggcggatgctgccatcgccaccgaggtcgcgactattgagccgactacagccgatgttgtcgctatcattgttgacccggggcagacggcatga

SEQ ID NO: 93 - protein, 811 aa, Pseudomonas aeruginosa
EEVIMKLQAYRLQNYRRLRDVVIELDDEISIFVGANNSGKTSAVQGLYSMLRGEVKKFELFDFSAALWAEIDAVGRTPPGDEDAPKRLPSILLDLWFRVGEDDLATAMSLLPSTEWDGKCVGIRVAFEPRDAHELVWKFHELHEKANNAAVALAAKRKAAGEQAVEAGAEDAAAVVADAGEYKPWPESLTKYLTKELSKEYTFRYYVLDERAFVGYQAREADYEPLPLGKEPGGAAILKSLVRVDFLRAQRHLDDPDAGSSDRAESLSRRLSRFYHRNLEKRGDDHAALKALDTSEKELNFHLKEVFNDTLTRLAKLGYPGVNNPEIVIRAALDPTTVLGQDAKVHYVIPGVASAQLPDSYNGLGFKNLVYMVVELLDLHEQWKAEDDKRAPLHLVFIEEPEAHLHAQIQQVFIRNVLRLLEDANDHATLFHTQLVITTHSPHILYERGFSPIRYFRRVNDQLGHHTDVRNLSLFKTGASDAPAREFLQRYLKLTHCDLFFSDAVILVEGNVERLLLPAMIELVAKRLRSSALTILEVGGAFAHRFQELIAFVGLTTLVITDLDSVTVKTDAEKAAAQGAGAEGAVDGDDEDEDDDLKPFELEDDDEAEPSGKKKSKKRGSTCHAHVEGAVTSNQTLISWIPKKRSMAELWEVTAEQKTLSLAEDSSAGVRVAYQTKVSVTVGATTSQLCGRTLEEAFGLENADWCQAEANRSVGLKLKRAPSSPEELAEKLHDRVVGKNFDKTRFALEVLASGPLNGWKVPAYIAEGLAWLEAKVAHELEADAAIATEVATIEPTTADVVAIIVDPGQTA

SEQ ID NO: 94 - DNA, 570 bp, Pseudomonas aeruginosa
cggaaggtgtattccttgctcagttcctttgtgaggtacttcgtcaggctttctggccaaggcttgtactcgccggcatcggccaccaccgcagccgcgtcttccgcgcccgcctccacagcttgctccccggcggccttgcgcttggccgcaagcgcgacagctgcgttgttggccttctcatgtagttcatggaacttccagacgagctcgtgggcatcccgaggctcgaacgctacccggatcccgacgcacttgccgtcccactcagtgctcggcagcagcgacatcgcagtggcgaggtcgtcttcaccgacgcggaaccagagatccaagagtatggacggtaaccttttgggcgcatcctcatcgccagggggcgtcctgccgaccgcatcgatctcggcccacagcgccgcactgaagtcaaagagctcgaacttcttcacttcgccgcgaagcattgagtacaggccttggacggcggatgtcttcccgctgttgttggcaccgacaaagatagaaatttcgtcatcgagctcgatgacaacatcgcgcagccggcggtag

SEQ ID NO: 95 - protein, 189 aa, Pseudomonas aeruginosa
RKVYSLLSSFVRYFVRLSGQGLYSPASATTAAASSAPASTACSPAALRLAASATAALLAFSCSSWNFQTSSWASRGSNATRIPTHLPSHSVLGSSDIAVARSSSPTRNQRSKSMDGNLLGASSSPGGVLPTASISAHSAALKSKSSNFFTSPRSIEYRPWTADVFPLLLAPTKIEISSSSSMTTSRSRR

SEQ ID NO: 96 - DNA, 390 bp, Pseudomonas aeruginosa
ggtacttcgtcaggctttctggccaaggcttgtactcgccggcatcggccaccaccgcagccgcgtcttccgcgcccgcctccacagcttgctccccggcggccttgcgcttggccgcaagcgcgacagctgcgttgttggccttctcatgtagttcatggaacttccagacgagctcgtgggcatcccgaggctcgaacgctacccggatcccgacgcacttgccgtcccactcagtgctcggcagcagcgacatcgcagtggcgaggtcgtcttcaccgacgcggaaccagagatccaagagtatggacggtaaccttttgggcgcatcctcatcgccagggggcgtcctgccgaccgcatcgatctcggcccacagcgccgcactga

SEQ ID NO: 97 - protein, 129 aa, Pseudomonas aeruginosa
GTSSGFLAKACTRRHRPPPQPRLPRPPPQLAPRRPCAWPQARQLRCWPSHVVHGTSRRARGHPEARTLPGSRRTCRPTQCSAAATSQWRGRLHRRGTRDPRVWTVTFWAHPHRQGASCRPHRSRPTAPH

SEQ ID NO: 98 - DNA, 546 bp, Pseudomonas aeruginosa
cgacagattgcgcacatccgtgtgatggcccaactggtcgttgacgcggcggaagtaccgaatgggcgagaatccgcgttcatagaggatgtgcggggagtgcgtggtgatgacgagctgcgtgtggaacaaagtcgcgtgatcgttagcatcctcaaggaggcgcaaaacgttcctgatgaagacctgctggatctgcgcgtgcagatgcgcctcaggctcctcaatgaagaccaaatgaagcggagctcgcttgtcatcctcggctttccactgctcgtgcaagtcgagcagctcaaccaccatgtagaccagattcttgaaccccaggccattgtagctgtctggcagttgggcggaagctacgcccgggatcacgtagtgaaccttggcgtcttgccccaagacagtggtcggatccaaggccgcccgaatcacgatctccggattgttgacgcccggatagccgagcttggccaggcgcgtgagggtgtcattgaagacttccttcaggtggaagttcagctccttctccgaggtatctag

SEQ ID NO: 99 - protein, 181 aa, Pseudomonas aeruginosa
RQIAHIRVMAQLVVDAAEVPNGRESAFIEDVRGVRGDDELRVEQSRVIVSILKEAQNVPDEDLLDLRVQMRLRLLNEDQMKRSSLVILGFPLLVQVEQLNHHVDQILEPQAIVAVWQLGGSYARDHVVNLGVLPQDSGRIQGRPNHDLRIVDARIAELGQAREGVIEDFLQVEVQLLLRGI

SEQ ID NO: 100 - DNA, 420 bp, Pseudomonas aeruginosa
cttccgcccaactgccagacagctacaatggcctggggttcaagaatctggtctacatggtggttgagctgctcgacttgcacgagcagtggaaagccgaggatgacaagcgagctccgcttcatttggtcttcattgaggagcctgaggcgcatctgcacgcgcagatccagcaggtcttcatcaggaacgttttgcgcctccttgaggatgctaacgatcacgcgactttgttccacacgcagctcgtcatcaccacgcactccccgcacatcctctatgaacgcggattctcgcccattcggtacttccgccgcgtcaacgaccagttgggccatcacacggatgtgcgcaatctgtcgctattcaaaacgggcgcgtccgacgctccagcgcgcgaattcctgcagcggtatctga

SEQ ID NO: 101 - protein, 139 aa, Pseudomonas aeruginosa
LPPNCQTATMAWGSRIWSTWWLSCSTCTSSGKPRMTSELRFIWSSLRSLRRICTRRSSRSSSGTFCASLRMLTITRLCSTRSSSSPRTPRTSSMNADSRPFGTSAASTTSWAITRMCAICRYSKRARPTLQRANSCSGI

SEQ ID NO: 102 - DNA, 2101 bp, Pseudomonas aeruginosa
caaagcataagaccaagatggcacattgccaacaaaatacccttccccgctaccgttgttttatcgttgttgccagccctgatctggcggaaaagcccgctccatgaatcgtcatggagcctcccatgtttcaactcctttcctggatatccaggaagccgtcccccaccccaacaaccaaagctgccccagggggattcatccttcctctgagcagcatggaactgctcggcacgcctcgccgccggcagctactggagaacatctggcagcgcgcctcgctatccaagcagcaattcgaggagatctaccggcggccactggccaactatgccgagctggtccagcagctccctgcttcggaaaatcatcaccatgcccatccaggcgggatgatcgatcacggcctggagatcgtggcctacgcactcaaggtacggcagacctacctgctcccgatcggcgcagcgccggagtcacagtcagcccaggctgaagcctggtcggccgccgcggcgtatggcgccctggctcatgacataggcaagatcgtcgtcgacctgcaggttgagctacaggacggcagcacctggcacccttggaacggaccgatcaaccagccataccgcttcaagtacgtgaagtcccgcgaataccagctccacggcgctgcctcagcacttctcatccaccaactgctaccgcgcactgcactcgattggctcagtcgctttccagagctgtgggctcaattgatctacctgttcgctgggcagtacgagcacgccgggatcctcggcgagatcatcgtgaaggcagaccaggcctcagttgcacaggagctaggaggcaatccggatcgagctctggctgcaccgaagcagtcgctgcagcggcagttggcagacggccttcgcttcttggtgaaggacaagttcaagttgaatcaacctagcggcccgtctgatggatggctgacccaggacgcactctggctggtgagcaagcctgctgccgatcaactgagagcctacctgctggcccagggtatcgatggggtgccctcctctaacgcgccgttcttcagcatgctccaggaccaagccgtcatccagacaaatgccgaggacaaggccatttggacggccacggtagacaacggtgctggatggagaaacaagttcacgctactcaagattgctccagccttgatctggacagatgctgccgagcgcccctcaccctacagcggatcactggtcgttgaagatggaaccgcctcaacggaaaagccggaaacgacctgtgaaattcccaacgggccggctgaacagcagcaagcaccagaaacgaagatgatgctccatcaacctgcgccgagcgttgcgaaaccggcaaacgagacgcaggcgattgcgaaaccctcaactgatgatcaagaagaaacagacgatttgtatgcacttcttggtaatatcaattcgccactagaagagctagacactagccacgactcgccggctgcctctcctacgaacacacgcggggaggagaacctacagcagccactagggaccaaggagccaacagattgcgctcctgaagcaattgaagatgtatttatgcctagcagaagtactgatctgggacagggattcgttggttggatgaaatctggcatcgcggcccgtcgcctgttcatcaacgacaccaaggctttggtgcataccgtagacgggaccgccatgctggtcacgccaggaattttcaagcgctatgtccaagagcatccggtgcttgaaaaactggcccaagccaaggagacgaccggctggaagctggtgcagcgcgcgttcgaaaaacaggggcttcatcggaagaccagtaaaaacctgaacatctggaccatcaaggtttctggtcctcgcaagacgaaagagctcaaggcctacctgctccaggatcccaaattgctgttccctgagcagcctctggacaacccaagcctcacggtcatcaccgatgccgaaggaggtgtggaatgacgccgcagcagctcaccgaggagtacatcttcgcgcacgatctccgggaagccagc

SEQ ID NO: 103 - protein, 641 aa, Pseudomonas aeruginosa
MNRHGASHVSTPFLDIQEAVPHPNNQSCPRGIHPSSEQHGTARHASPPAATGEHLAARLAIQAAIRGDLPAATGQLCGVGPAPCFGKSSPCPSRRDDRSRPGDRGYALKVRQTYLLPIGAAPESQSAQAEAWSAAAAYGALAHDIGKIVVDLQVELQDGSTWHPWNGPINQPYRFKYVKSREYQLHGAASALFIHQLLPRTALDWLSRFPELWAQLIYLFAGQYEHAGILGEIIVKADQASVAQELGGNPDRALAAPKQSLQRQLADGLRFLVKDKFKLNQPSGPSDGWLTQDALWLVSKPAADQLRAYLLAQGIDGVPSSNAPFFSMLQDQAVIQTNAEDKAIWTATVDNGAGWRNKFTLLKIAPALIWTDAAERPSPYSGSLVVEDGTASTEKPETTCEIPNGPAEQQQAPETKMMLHQPAPSVAKPANETQAIAKPSTDDQEETDDLYALLGNINSPLEELDTSHDSPAASPTNTRGEENLQQPLGTKEPTDCAPEAIEDVFMPSRSTDLGQGFVGWMKSGIAARRLFINDTKALVHTVDGTAMLVTPGIFKRYVQEHPVLEKLAQAKETTGWKLVQRAFEKQGLHRKTSKNLNIWTIKVSGPRKTKELKAYLLQDPKLLFPEQPLDNPSLTVITDAE

SEQ ID NO: 104 - DNA, 1659 bp, Pseudomonas aeruginosa
tgcgcaacgatacgccgttgccgacgatccaggcggcattgctggccgacggttgcgaactgctggtgctgtcgccggggcccggtcggccggaagacgccggctgtatgctggaattgctcgcctgggcccgcgggcgcttgccggtgctcggcgtctgcctcggccaccaggcgctggcgctggccgccggtggcgcggtgggcgaggcgaggaagccgctgcatggcaagagcacgtccctgcgtttcgatcagcgtcacccgctgttcgacggcatcgctgacctgcgcgtcgcgcgctaccactcgctggtggtcagtcgcctgccggaaggtttcgactgcctggccgatgccgatggcgagatcatggcgatggccgatccgcgcaatcgacagctgggcttgcaattccatcccgagtcgattctcaccacccacggccagcgtctgctggagaacgctctactctggtgcggcgcgttggcggtcgcggagcgccttcgggcctgagcggcgctgcgcagtttcgaccgaggctcggttgccaggccggcgcatcgtcgaaacgctggcggcccagttcgcgcaggcgctggcgggcgctttcgagaaagcgacggaagctgcgctcggattccagcgcggtgttgtagtagcaatacaccttggtgtcgatgccgcccggttcgtacagttcgctgaggactgccagggtaccgttgcgcaggcgttcctcgacgaaataatgcggcgagatgccccatccgacgccggcttccaccagacgcagcatgtcgtcgaagttttccacgaagagcaccttgtcgctgaccggccgcagcaggttcgaatgctgcccggagcggctgccgaggctgatctgccggtaattggccaggctcgcgatgctgtgcagggaggcattgcacaacgggtgctgcggatgggcgacgacgaacgccttggtgtagccgagcacgcactggttgaagcgggagatcttcagttcctcgtcgatggtgatggcgatatcgatttccgcgttgtcctgcttgatcgtcgccaggctatcggcgggcgaggtgcgtatcaggctgaccatgttgaaatcgtcgagcagtacgctgctcaccgtatcgcagaacgacggcgggatggcggtgtccagcagcacccggagattgcgcggacccttgttgagattgaaggcgatgtcgccgatcagctgctggtagttcagcaggctgcgcatgtaagggatcaggcgaagcgcctgctcggtgggttcgaccttgtagccgtcccgacggaccagctccacgcacaggtcgatttccaggttgctgaccgccgagctgaccgcggtgtgcgacttgcgcaggatccgcgcagcggaggaaatcgaaccggaggcgatgacctggaggaacatgttcacgtgattcaggttatgaataggcatcccttattccttttattgggtggcgcgtgccgcttcccttgatcgggtcaggttgccgctactgtggaagaagcgtcgaggactcgatagatagcgcccgagtgtttcaacttgtcttctggatgacgttttcatcggggaaacctcccgtcggtcagtgaatcgcaagggctggcgtgcgagggtggaatc

SEQ ID NO: 105 - DNA, 1284 bp, Pseudomonas aeruginosa
atggcaagagcacgtccctgcgtttcgatcagcgtcacccgctgttcgacggcatcgctgacctgcgcgtcgcgcgctaccactcgctggtggtcagtcgcctgccggaaggtttcgactgcctggccgatgccgatggcgagatcatggcgatggccgatccgcgcaatcgacagctgggcttgcaattccatcccgagtcgattctcaccacccacggccagcgtctgctggagaacgctctactctggtgcggcgcgttggcggtcgcggagcgccttcgggcctgagcggcgctgcgcagtttcgaccgaggctcggttgccaggccggcgcatcgtcgaaacgctggcggcccagttcgcgcaggcgctggcgggcgctttcgagaaagcgacggaagctgcgctcggattccagcgcggtgttgtagtagcaatacaccttggtgtcgatgccgcccggttcgtacagttcgctgaggactgccagggtaccgttgcgcaggcgttcctcgacgaaataatgcggcgagatgccccatccgacgccggcttccaccagacgcagcatgtcgtcgaagttttccacgaagagcaccttgtcgctgaccggccgcagcaggttcgaatgctgcccggagcggctgccgaggctgatctgccggtaattggccaggctcgcgatgctgtgcagggaggcattgcacaacgggtgctgcggatgggcgacgacgaacgccttggtgtagccgagcacgcactggttgaagcgggagatcttcagttcctcgtcgatggtgatggcgatatcgatttccgcgttgtcctgcttgatcgtcgccaggctatcggcgggcgaggtgcgtatcaggctgaccatgttgaaatcgtcgagcagtacgctgctcaccgtatcgcagaacgacggcgggatggcggtgtccagcagcacccggagattgcgcggacccttgttgagattgaaggcgatgtcgccgatcagctgctggtagttcagcaggctgcgcatgtaagggatcaggcgaagcgcctgctcggtgggttcgaccttgtagccgtcccgacggaccagctccacgcacaggtcgatttccaggttgctgaccgccgagctgaccgcggtgtgcgacttgcgcaggatccgcgcagcggaggaaatcgaaccggaggcgatgacctggaggaacatgttcacgtgattcaggttatgaataggcatcccttattccttttattgggtggcgcgtgccgcttcccttga

SEQ ID NO: 106 - DNA, 1035 bp, Pseudomonas aeruginosa
atgcctattcataacctgaatcacgtgaacatgttcctccaggtcatcgcctccggttcgatttcctccgctgcgcggatcctgcgcaagtcgcacaccgcggtcagctcggcggtcagcaacctggaaatcgacctgtgcgtggagctggtccgtcgggacggctacaaggtcgaacccaccgagcaggcgcttcgcctgatcccttacatgcgcagcctgctgaactaccagcagctgatcggcgacatcgccttcaatctcaacaagggtccgcgcaatctccgggtgctgctggacaccgccatcccgccgtcgttctgcgatacggtgagcagcgtactgctcgacgatttcaacatggtcagcctgatacgcacctcgcccgccgatagcctggcgacgatcaagcaggacaacgcggaaatcgatatcgccatcaccatcgacgaggaactgaagatctcccgcttcaaccagtgcgtgctcggctacaccaaggcgttcgtcgtcgcccatccgcagcacccgttgtgcaatgcctccctgcacagcatcgcgagcctggccaattaccggcagatcagcctcggcagccgctccgggcagcattcgaacctgctgcggccggtcagcgacaaggtgctcttcgtggaaaacttcgacgacatgctgcgtctggtggaagccggcgtcggatggggcatctcgccgcattatttcgtcgaggaacgcctgcgcaacggtaccctggcagtcctcagcgaactgtacgaaccgggcggcatcgacaccaaggtgtattgctactacaacaccgcgctggaatccgagcgcagcttccgtcgctttctcgaaagcgcccgccagcgcctgcgcgaactgggccgccagcgtttcgacgatgcgccggcctggcaaccgagcctcggtcgaaactgcgcagcgccgctcaggcccgaaggcgctccgcgaccgccaacgcgccgcaccagagtagagcgttctccagcagacgctggccgtgggtggtga

SEQ ID NO: 107 - protein, 427 aa, Pseudomonas aeruginosa
MARARPCVSISVTRCSTASLTCASRATTRWWSVACRKVSTAWPMPMARSWRWPIRAIDSWACNSIPSRFSPPTASVCWRTLYSGAARWRSRSAFGPERRCAVSTEARLPGRRIVETLAAQFAQALAGAFEKATEAALGFQRGVVVAIHLGVDAARFVQFAEDCQGTVAQAFLDEIMRRDAPSDAGFHQTQHVVEVFHEEYLVADRPQQVRMLPGAATEADLPVIGQARDAVQGGIAQRVLRMGDDERLGVAEHALVEAGDLQFLVDGDGDIDFRVVLLDRRQAIGGRGAYQADHVEIVEQYAAHRIAERRRDGGVQQHPEIARTLVEIEGDVADQLLVVQQAAHVRDQAKRLLGGFDLVAVPTDQLHAQVDFQVADRRADRGVRLAQDPRSGGNRTGGDDLEEHVHVIQVMNRHPLFLLLGGACRFP

SEQ ID NO: 108 - protein, 344 aa, Pseudomonas aeruginosa
MPIHNLNHVNMFLQVIASGSISSAARILRKSHTAVSSAVSNLEIDLCVELVRRDGYKVEPTEQALRLIPYMRSLLNYQQLIGDIAFNLNKGPRNLRVLLDTAIPPSFCDTVSSVLLDDFNMVSLIRTSPADSLATIKQDNAEIDIAITIDEELKISRFNQCVLGYTKAFVVAHPQHPLCNASLHSIASLANYRQISLGSRSGQHSNLLRPVSDKVLFVENFDDMLRLVEAGVGWGIAPHYFVEERLRNGTLAVLSELYEPGGIDTKVYCYYNTALESERSFRRFLESARQRLRELGRQRFDDAPAWQPSLGRNCAAPLRPEGAPRPPTRRTRVERSPADAGRGW

SEQ ID NO: 109 - DNA, 128 bp, Pseudomonas aeruginosa
aagggttttggcggggtcatccgagtgaccctgagcatgctcctggcgatcttcttgtcggtgctgctggcgccggtgcgcatgctgttccacacccgcttcgtgctggccgccttcctcggctggtc

SEQ ID NO: 110 - protein, 42 aa, Pseudomonas aeruginosa
KGFGGVIRVTLSMLLAIFLSVLLAPVRMLFHTRFVLAAFLGW

SEQ ID NO: 111 - DNA, 6909 bp, Pseudomonas aeruginosa
ctactggggcaagctgaagacgccgttcaagctgagcttctatcaccagggcatgcacttcgacacgccggtgaagatcaacgaggtgaccgctaccacggtcaagccgatcaagtacgatcgcaccaagttcgatttcggatccctgaagttcgacgagaatgccaccaaggatctcggctatgccggtttccgcgtgctctatccgatcaacaaggccgacaagcaggacgagatcgccaccttccttggcgcgagctacttccgcgtggtcggcaagggccaggtctacggtctgtcggcgcgcggcctggcgatcgataccgcgctgccttcgggcgaagagttcccgcgcttccgcgaattctggatcgagcggccgaagcgcaggacaagcaactggtgatctacgccctgctcgactcgccgcgggccaccggcgcctaccgcttcgtgctgcgtccgggcaaggatgcggtgatggatgtccaggcccgcgtgttcctccgcgacaaggtcagcaagctgggcctggcgccgctgaccagcatgtacctgttcggctccaaccagccgtccgagcagcacaacttccggcccgagctgcatgactccagcggcctgcagatccatgccggcaacggcgagtggctgtggcgtccgctgaacaatccgaagcacctgtcggtgagcaccttcagcgtggagaacccgaaaggcttcggcctgctccagcgcggccgcgagttctcccgctacgaagacctggatgaccgctacgacctgcgtccgagtgcctggatcgagccgaagggcgactggggcaagggcaccgtggaactggtggaaatcccgaccccggacgaaaccaacgacaatatcgtcgcgttctggaaccccgagacccagcctgaggtcggaaagccgctggacttcgcctaccgcctgcactggaccatggatgaagacgagctgcacgacccgaaatcctcctgggtcaagcagaccatgcgctcggtcggcgacgtgaagcagaagaacctgatccgccagcaggacggcagcaccgccctggtcgtcgacttcgaagggccggccctgaaggacctggcgccggacgcgccggtgaccacccaggtcagcaccgacagcaacgccgaggtggtggagaacagcctgcgttacaacccggtcctgaaaggctggcgcctgacgctgcggatcaaggtcaaggatccgaagaagccggtggaaatgcgcgcggcgctggtcgacgaggcgcagaagccactgagcgaaacctggagctatcagctgcctgccgatgaataacccatccactacgaaagcaccgctggccgactacctcgctcatcttcccctggcggaagaggagcgggagcgccttggcgagtccgcttccttctccgagctgcacgctcgcctggcgggagcggaaggcgccgctgccgatgccgggggcgatcccgccctggcctcggtacgcgcccgcctgcagctgggcacccctgagctggacgacgccgagatgttcggcgtcgacgcccagggtcgcaccttcctcaagatttccccgccgatccgccgtaccaaggtgattcccgagccctggcgcaccaacatcctggtgcgcggctggcgtcggctgaccggacgcagcaacccgcccaagcccaagcgtgccctgccgcgggcccgctggcagcgggtcggctcgctgcgccggttcatcctgctgttgttgatgctggcgcagacctcggtcgccacctactacatgaaaggcatcctgccctaccagggctgggccttcgtcgacctggaggagctggcccagcagagcctgctggataccgtccagcaggtgctgccctatgtcatccagttcggcatcctggcgctcttcgcgatcctcttctgctgggtctcggccggcttctggaccgcgctgatgggcttctgggagctgctcaccgggcgtgaccgctaccggatctccggcagcagcgccggcagcgagccgatcgccgccgacgcccgcacggcgatcgtcatgccgatctgcaacgaagacgtgccgcgggtattcgccggcctgcgggcgaccgtcgagtcgatggccgccaccggcgagatggagcgcttcgacttcttcgtcctcagcgacaccaacgacccggatatcgccgtcgccgagcagcaggcctggctcgagctgtgccgcgagaccaagggcttcggcaagatcttctaccgtcgccgccggcgccgggtgaagcgcaagagcggcaacatcgacgacttctgccggcgctggggcggcgactaccgctacatggtggtgatggacgccgacagcgtgatgagcggcgactgcctggccaagctggtacgcctgatggaggccaatcctgaggcggggatcatccagaccgcgccgaaggctccggcatggacaccctgtatgcgcgcatgcagcagttcgccacccgcgtctacggcccgctgttcaccgccggcctgcacttctggcaactcggcgagtcgcactactggggccacaacgcgatcatccgcatgcagcccttcatcgaccactgcgccctggcgccgttgccgggcaagggctcgttcgccggcgcgatcctgtcccacgacttcgtcgaggctgcgttgatgcgccttgccggctggggcgtgtggatcgcctacgacttcgacggcagctacgaagaactgccgccgaacctgctcgacgaactcaagcgcgaccgccgctggtgccacggcaacctgatgaacttccgcctgttcctggtcaagggcatgcacccggtgcaccgcgcggtgttcctcaccggggtcatgtcctacctgtcggcgccgttgtggttcttcttcctggtgctttccaccgcgctgctggcggtgcaccaactgatggagccgcagtacttcctggaaccgcggcagctgttcccgatctggccgcagtggcatccggagaaggccatcgcgttgttctccaccaccctgaccctgttgttcctgcccaagctgctcagcgtaatgctgatctgggccaagggcgccaagggtttcggcggggtgatccgggtgaccctgagcatgctcctggagatgttcttctcggtgctgctggcgccggtgcgcatgctcttccacacccgcttcgtgctggccgccttcctcggctggtcggtgcagtggaactcgccgcagcgcgacgacgacgccacgccctggagcgaggcgatccgccggcacgcaatgcagaccctgctgggtatcgcctggaccctgctggtggcctggctcaacccgcgcttcctgtggtggctgtcgccgatcgtcggttcgctgatcctgtcgatcccggtatcggtgatctccagccgggtgaagctgggcctgcgggcccgctacgaaaagctggtcctgatcccggagagtacgacacgccgcgcgactgcgcgccaccgacgagtacacctacgagaaccgctggcatgcgctcaaggatggcttcctcaaggccgccgtcgatccgttgctcaacgccctggcctgcgccatgggcacggctcgccacaaccgtgcgcaggccatcgagacggtgcgtggcgagcgtatcggcaaggccatcgataagggcccggaacagctcgacggcgccacgcgcctggctctgttgagtgacccggtagcactttcgcgcctgcatacgcgggtctgggaagaggaccgcgacgactggctcggccgctggcgcaaggccgaggcggacgacccccacgccgccagcgtaccgctggcccaggtagtgcccggcgacgccggcctgctgcccgccgcccagtcctgatcccatgcccccggcggaacgccgccgggggcatgggtctgtttcttgcctgttttccccgtgcggcgctgctgttaccctgcgccggcaatccagaaagtctcgtatcgttcgccagctgaggtactatcggccgccttttgcgcagccggtcatggcctgctgcccgcccgggacggcgacacgacgagagcatccgttcgacgactgtgtttctaagactgctggggattggggaatgaaaaagtatcttgcttcattggttctgggcgtctgcgccctggtgggcgtggcttcggtccaggcggccggcgcggtggaggacgcggtcaagcgcggcaccctgcgggtcggcatggacccgacctacatgccgttcgagatgaccaacaagcgtggccagatcatcggcttcgaagtcgacctgctcaaggccatggccaagtccatgggcgtcaagctggagctggtctccaccagctacgacggcatcatcccggcgctgctgaccgacaagttcgacatgatcggctcgggcatgaccctgacccaggagcgcaacctgcgcctgaacttctccgagcccttcatcgtggtcggccagaccctgctggtgcgcaaggaactggaaggcaagatcaagtcctacaaggacctgaacgatccgcagtacagcatcacctcgaagatcggcaccaccggtgagatcgttgcccgcaagctgatcagcaaggccaagtaccacggcttcgacaacgagccggaagcggtgatggacgtggtcaacggcaaggccgacgccttcatctacgactcgccctacaacgtggtggcggtgagcaagttcggcgccggcaagctggtctacctcgaccagccgttcacctacgagccgctggcgttcggcctgaagaaaggcgactacgacagcatcaatttcatcaacaacttcctccatcagatccgcgaagacggcacctatcagcgcatccacgacaagtggttcaagaacaccgagtggctgaaggaaatggaatgaaccgctgacggcccccgcgaagggggccgtcgtacctgcgcattccatcgttcgagagagtttccgtgaccaagaagaaacgttccgtctggccctggcacctgctgaccgggctgatcctgctggtcatggcctgggcgctgtggttctccacctcgctgatttcctatgaaatggcgtgggaccgcgtttccgagtacttcgctaccaggccgaggagccgttacgggccaacgagatcggccgggtcgaggctatcgaggaacagggcagggacgcgcgcgtcacgctgcttggcgagacggcgagaagcaggtcgtgaccgttgcccaggacagcctgcaattctccgaagcgacgacgtggccgagggcgacgcggtcggggtgacccgccactgggccgccggcactgctctggggcctgtggaccaccctctggctatcgctggtgtccggtgccatcggtctggctatcggcctggtcgccggcctctgccggctgtcgaagaacccgaccctgcacgacctgtcgacgatctacgtcgagctggtgcgcggcacgccgttgctggtgcagatcttcatcttctacttcttcatcggcaccgtgctcaacctgtcccgcgagttcgccggggttgcggcgctggcgctgttcaccggcgcctacgtggccgagatcatccgggccggcgtgcagtccatcgcccgcggacagaacgaggccgcccgctccctgggcctgaacgccggccagtcgatgcgctacgtgatcctgccgcaggcttcaagcgcgtgctgccgccgctggccgggcagttcatcagcctggtcaaggacacctcgctggtctcggtgatcgccatcaccgaactgaccaagagcggccgcgaggcgatcacccacttcgttctccaacttcgagatctggtttctgcgtcgccgcgttgtacctgctgttgaacctgcccctttcgcacatggcatcccgactggagcggaggctcggacaaagtgattgaagtacgcaacctgctgaaggtcttcgatacccgcggccaggtagtgcgcgcggtggacgacgtgagtacccgcgtggccaggggcgaggtactggtggtgatcggtccgtccggttccggcaagtcgaccttcctgcgctgcctgaacggcctggaggagttcgacgaaggctcggtgagcatcgacggcgtcgacctggccgacccgaggaccgacatcaatgcctaccgccgcgaagtcggcatggtgttccagcatttcaacctgttcccgcacatgaccgtgctcgagaacctctgcctggcccaacgcgtggtgcgcaagcgcggcaaggccgagcgcgaggccaaggcgcgggcgctgctggccaaggtcggcatcgggcagaaggccgacgaatatccctcgcgcctgtccggcggccagcagcagcgcgtggcgatcgctcgcgcgttgtgcatggaccccaaggtgatgctgttcgacgaaccgacctcggcgctcgatccggagatggtcggcgaagtcctcgacgtcatgaagaccctggccgtggaaggcatgaccatggtctgcgtgacccacgagatgggctttgcccgcgaagtggccgaccgcgtgctgttcttcgaccacggcaagctgctggaggacgcgccgccggcgcagttcttcgacaatccgcaggacccgcgggcccaggccttcctccgccaggtcctctagtaccgcgctaggcgaacggcttgcccggcggcggcaggagcgacgtcggactctgccgcgcggccggctggatatcgttgtcctccagccagtccagcgcccattcgcgcaggcgctcgttctggtagcggtaccagtcctgcaacagttccgggtactccatcagagagtgcttgaaggccttgaacggcttgcggctctgcagcgcgttg

SEQ ID NO: 112 - DNA, 107 bp, Pseudomonas aeruginosa
cgaggtttccgtctacgaaggcaccggctcggtcaccatccgcgccgtgttccccaacccgaacaacgagctgctccccggcatgttcgttcacgcgcagttgcagg

SEQ ID NO: 113 - protein, 35 aa, Pseudomonas aeruginosa
EVSVYEGTGSVTIRAVFPNPNNELLPGMFVHAQLQ

SEQ ID NO: 114 - DNA, 2051 bp, Pseudomonas aeruginosa
gcaagctcaactccagcaacaaggcggaggccaccatgaaggcttacgccatcggcctgctcaactgaatcgacgcctcgtcgcctagcgaggccgccgcgcaagcgtccggccattcaccgaatggccggatagcgtttgcgccggtcgcctgagcgcacgcttcccaccggcagcgtttccccgctgcccccttcgccattgcgcccgtcctcatgttgtccggacgctagtcgaactttccgggcgcctggcaaaccggccaaagaatagaacggaatcgatgcccacacctttaatttttaagggtttttccttttcaaaaaccgttattaagttttcccctttaaatcttggtacaactgggttcaggcgaaacttcggtcatgccattcggcattagttaaactttgagactctccaagcgggaatttttgccggaacagcttcacggcatttctccgctttcatcccgatgtttctttccgttatgattccagtcgattcgaactgccggagttcccaccattcgagattaccaacgttgaaaagggtttaccgacaacctggaattgcgtcggcgcaaccgtgccacggtcgagcactacatgcgcatgaagggggccgaacggttacagcggcacagcctgttcgtcgaggaggctgcgccggcaactggaccacggaaagcggcgaacccctggttttccggggccatgagagcctcaggcggctcgccgagtggctcgagcgctgcttccccgactgggagtggcacaacgtgcggatcttcgagaccgaggatccgaaccacttctgggtcgagtgcgacgggcgcggcaaggcgctggtcccggggtatccgcagggctattgcgagaaccactacatccattccttcgaactcgagaacggccggataaaacgcaatcgcgagttcatgaacccgatgcagaaattgcgtgcattgggaatagccgttccacaaataaaacgtgacggtattcccacctgattaatgtctattccaattcaagaggagatatgacgatgctcgataatgccattcctcaaggtttcgaagacgccgtggagttgcgcaggaagaatcgcgagacggtggtcaagtatatgaacaccaaaggccaggatcgcctgcgccgccatgaacttttcgtcgaggacggctgtggcggtttatggaccaccgataccggctcgcccatcgtcattcgtggcaaggacaagctggccgagcacgcggtgtggtcgctgaaatgcttcccggattgggagtggtacaacatcaaggtcttcgagaccgacgatcccaaccacttctgggtcgagtgcgacggccacggcaagatcctcttccccggctatcccgagggctactacgagaaccacttcctgcattccttcgagctggacgacggcaagatcaagcgcaaccgcgaattcatgaacgtcttccagcaattgcgcgccctgagcattccggtcccgcagatcaaacgcgaaggcattcccacctgaggccatcctggaaggggtgaactatggacgatctattgcaacgcgtacggcgctgcgaagcgctgcagcaacccgaatggggcgatccgtcgcgcctgcgcgacgtgcaggcgtacctgcgcggcagtccggcgctgatccgcgccggcgacatcctggccctgcgcgcgaccctggcgcgggtcgcccgcggcgaggcgctggtggtgcagtgcggcgactgcgccgaggacatggacgaccaccatgccgagaacgtggcgcgcaaggccgccgtgctggaactgctggccggcgccctgcgcctggccggccggcggccgatagatccgcgtcgggcgcatcgccgggcagtacgccaagccgcgttccaagccgcacgagcaggtcggcgagcagaccctgccggtctatcgcggcgacatggtcaacggccgcgaggcccatgccgaacagcgccgggccgatccgcagcggatcctcaagggctatgcggcggcgcgcaacatcat

SEQ ID NO: 115 - DNA, 1266 bp, Pseudomonas aeruginosa
cggcgccgaggatccgctgttcgagttaggcgcaagcgtccggccattcacggaatggccggatagcgtttgcgccggttgcttgagcgcagcttcccaccggcagggtttccccgctgcccctttcgccattgcgccgtcctcttgttgtccggcacgctagtgcaactttccggacgcttggcaaaccggccaaagaatagaacggaatcgatgccccacacctgtaatttttaaggggttatggctattgcaaaaaagcgtttataagtttgtcccctgtcaaatctggttacaactgggtttcaggcgaaacattcggtcatggcaattcggcattagttgaaactttggagacgctccgaagcgggcaacttttgcccggaaaaagtttcacggcaatttttccggcctgtcatcccgatgtcttctttccagtatggatgccagtcgattcgaactggcggagattcgcaccatgcgagagtaccaacggttgaaagggtttaccgacaacctggaattgcggcggcgcaaccgtgccacggtcgagcactacatgcgcatgaagggggccgaacggttgcagcggcacagcctgttcgtcgaggacggctgcgccggcaactggaccacggaaagcggcgaacccctggttttccggggccatgagagcctcaggcggctcgccgagtggctcgagcgctgcttccccgactgggagtggcacaacgtgcggatcttcgagaccgaggatccgaaccacctctgggtcgagtgcgacgggcgcggcaaggcgctggtcccggggtatccgcagggctattgcgagaaccactacatccattccttcgaactcgagaacggccggataaaacgcaatcgcgagttcacgaacccgatgcagaaattgcgtgcattgggaatagccgttccgcaaataaaacgtgacggcattcccacctgattaatgattattccaattcaagaggagatatgacgatgctcgataatgctattccccaaggtttcgaagacgccgtggagttgcgcaggaagaatcgcgagacggtggtcaagtatatgaacaccaaaggccaggatcgcctgcgccgccatgaacttttcgtcgaggacggctgtggcggtttatggaccaccgataccggctcgcccatcgtcattcgtggcaaggacaagctggccgagcacgcggtgtggtcgctgaaatgccttcccggattgggagtggtacaacatcaaggt

SEQ ID NO: 116 - protein, 437 aa, Pseudomonas aeruginosa
MREYQRLKGFTDNLELRRRGSAVRVRRKRPAIHGMAGZRLRRLLERSFPPAGFPRCPFRHCAVLLLSGTLVQLSGRLANRPKNRTESMPHTCNFZGVMAIAKKRLZVCPLSNLVTTGFQAKHSVMAIRHZLKLWRRSEAGNFCPEKVSRQFFRPVIPMSSFQYGCQSIRTGGDSHHARVPTVERFTDNLELRRRNRATVEHYMRMKGAERLQRHSLFVEDGCAGNWTTESGEPLVFRGHESLRRLAEWLERCFPDWEWHNVRIFETEDPNHLWVECDGRGKALVPGYPQGYCENHYIHSFELENGRIKRNREFTNPMQKLRALGIAVPQIKRDGIPTZLMIIPIQEEIZRCSIMLFPKVSKTPWSCAGRIARRWSSIZTPKARIACAAMNFSSRTAVAVYGPPIPARPSSFVARTSWPSTRCGRZNAFPDWEWYNIK

SEQ ID NO: 117 - protein, 88 aa, Pseudomonas aeruginosa
MLDNAIPQGFEDAVELRRKNRETVVKYMNTKGQDRLRRHELFVEDGCGGLWTTDTGSPIVIRGKDKLAEHAVWSLKCLPGLGVVQHQG

SEQ ID NO: 118 - DNA, 216 bp, Pseudomonas aeruginosa
accaacatcctggtcctgagcaacagccagcgccacggcctggccgccgcctggccgatcgtgctcggcgcctgcgcggcggtggcggcgctgatcctgctgctcgggctcggcctgggcgagctgctgcggcgccacccgttgctccagcaggggctcgcctggcttggcgtcggctggctcagctacctggcctggagcctgttccgcagcgcg

SEQ ID NO: 119 - DNA, 103 bp, Pseudomonas aeruginosa
ccaccgaagtaacgggtcagctcgtcgcacaacaggcgtcgctcctcggcctgcatcaggctgcccagcgggccctggaaccagtcgcgcgcgcccggttgat

SEQ ID NO: 120 - DNA, 147 bp, Pseudomonas aeruginosa
gcggtgccctggatgtcgtcgttgaagcagcacagctcgtccttgtagcgctccagcaacggcatggcattggtctgggcgaagtcctcgaattgcagcaggaccttgggccacggcgcttgatcgcctggatgaacaggtcgacaa

SEQ ID NO: 121 - DNA, 140 bp, Pseudomonas aeruginosa
  variation (1)...(140): N is any nucleic acid.
tatttgtgtataagnctcaggctctggaggggccgctgggcaggcnnaacnncctcgcgtnctnggcgacganttncnnatgcttcgcntgctgccggcgtctcnnccctcngtactagtctacgcgtggacaacgtggc

SEQ ID NO: 122 - DNA, 304 bp, Pseudomonas aeruginosa
  variation (1)...(304): N is any nucleic acid.
natttgtgtataagagtcaggatcgaacgcttctcttcgccgcaggaaagccaccgccgagctgctgaagatgctcgagcgcaagggacaagatcatgggcttcgggcatnccntctnnatcgattcctncccacgcaacgaagtgatcaagggttggtcgaagcagctcgccgacgaggtcggcgacaaggtcctgttcgcggtttccgaggccatcgacaagaccatgtgggagcagaagaactgttccccaacgccgacttctaccacgcctcggcgtcncccntccngtgcttccacctt

SEQ ID NO: 123 - DNA, 45 bp, Pseudomonas aeruginosa
tcgttgtacaggccgaacaggccgagctgccaggtgtcgccctcg

SEQ ID NO: 124 - DNA, 406 bp, Pseudomonas aeruginosa
gagcagacctgggtacccatggcttccttgacccgctgcacgatgatgcccagcgccgccttcagatccttggcggagttctcttcctggacgatcttgcgcagcgtgttgagcatgctcggggccttgtctccgtgttcagtcccgcgccagaaggcgcggggccagttccttcagggcgcggcggtagacctcgcgcttgaaggtcaccacctgtcccagggggtaccagtaactcacccagcgccagccgtcgaactcgggcttgctggtgatatccatgcgcacgcgcgcctcgtcggacatcagccgcagcaggaaccatttctgcttctggccgatgcacagcggctggctgtgggtccgcaccaggcgctgcggcaaacggtagcgcagccagccgcgg

SEQ ID NO: 125 - DNA, 200 bp, Pseudomonas aeruginosa
cgcgacagtagcatataatcaatcatgagtgattaattaattggcgtttctgtaacatatccttatgatctgcggcgcctttcccttgtgaggacgttcagtggccaggaaaaccaaagaggaatcccagaaaacccgcgacggcatactcgatgccgccgagcgggttttcctggaaaagggcgtgggcaccactgcca

SEQ ID NO: 126 - DNA, 117 bp, Pseudomonas aeruginosa
tcgatcccaatgactacaaggacgaaatccgccagatcgcccgcgacaaggccaacctggagctggacctgaagggcgacatcggctggagcctgttcccctggctgggcctggagc

SEQ ID NO: 127 - DNA, 325 bp, Pseudomonas aeruginosa
ggataggtgcggcggaaaacgtacgggacgaaagagcggttttcccgaatgacgcatcctcctgcaagcgcaacttgctggtggtcgatagcaagtaaggcgcgagacatgtcctgaacttcatgggggctttttcttatagggcggactgtcgattctgctagctggtaatccttcttttattgtctctgtgtgcgctttttgtatggatgtgtcgaatattttgaatatcgccgttcaactttatccagggccgcagttcagtgatttattttctcgaaaagtttgttttttccaatattcatgcttcatagtctggccggcc

SEQ ID NO: 128 - DNA, 360 bp, Pseudomonas aeruginosa
  variation (1)...(360): N is any nucleic acid.
gcaggaaaccgttctccanatcctgggcgagaatcctcggcacatgcacgccggctccggcgagcagtccggcgaccttgacgaacggtcggcagtcttcctggggcggcggcgcgtccatcaccaccaggctgcggtcccctccctgccagcggaaataacgacggaagctggcgtcgctactggccgggatcagttcggcggggggcacttccccccaaccttcggcaacgaacaactcgggcaaacaagagtccaaccagcaattcagctgctggaaacgggcatcatcagacatttacggggttctccacggccctagccgttgcgcaggtcatgctttattatccagcatctttt

SEQ ID NO: 129 - DNA, 3065 bp, Pseudomonas aeruginosa
ctgcagcgtctgccgaccctgctgcaactgatcccgggacacggcggcctgctgcgggggcggctggccgcggatggggccgagtcggcctataccgagtgtctgcgcctgtgccgacggttgctctggcgccagtccatgggcgagtccctcgacgaactgagcgaggagctgcaccgcgcctggggagggcagagcgtcgacttcctgcccggcgaactgcacctggggagcatgcgccggatgctggagattctctcccgccaggcgctgcctctggactgaggcggaacatccattgcggcgatcgcgcccgacggctgcggtcgcaattgggggaaatgggggtatcgatgatgaatatgccgttgcgcgctagcgtcgcgcaggccagtcgcccatgggcgcggggaggtggctcgtgagtggggttggctatcgactggaagaaagtctggagtaccgcacgctggtgccggaggcgctgtcgatctggcgcatggctggcgccaaccggatgctgttcgactgcttcgacgtggacagcaaggctgcgcggcgtagcgtggcgatcctttccagctgcctgcgcatcgagtgctgggggcgcgatgtggtgctgcgggcgttgaactccaacggacgcgccttgctggcgccgttgagcgaggcctgtccggcccaggtcacctgcttgcgtgacggcgacaccctgcactggcgcttccccccggaagagccgcatgcggacgagtggcgacgcctgcatggcctgtccagcctggaggcgctgcgccgcgtgctcggaacgctgggcgacgcggaggggcctgcgctgctgggcggcctgttcagtttcgacctggccgagcagttcgaacccttgccggcgccggccgaacctgcgcggcattgcccggactacctgttcctggtgccggagttgctgctggatatcgatcacctggcgcgccggacttcgctgcaagcgttcgtccacgatccggccgggcacgaccggttggccgccagcctgcgccaatgtgccgacgaattccatggcgccgtggaggaggcttccgagtcgccggtggcaggcgtacgggccggcaactaccaggtcgacctggacgatgcgagctttgcccgccaggtagaacgcctgcaggcccacgtgagggccggcgacgtgttccagatcgtaccttcgcgcagcttcagcatgccgtgcgcggacccctggcgggcctatcgccagttgtgcctgcgcaaccccagcccgtaccgcttcttcctcgatgcgggggacttctgcctgttcggcgcttcgccggagtcggcattgaagtacgacgcggagagtcgcgaggtggaactctatcccattgccggcacccgcccgcgcggatgcgatgcccggggcgccatcgatgcggaactggacaatcgcctggaagcggagttgcgcctggatgccaaggagatcgccgagcacatgatgctggtcgacctggcgcgcaacgatctggcgcgcgtctgccgcagcggtacccggcaggtgcgcgacatgctcaaggtcgatcgctacagccacgtgatgcacctggtctcgcgcgtggctggcgaactgcacggcgaactggatgcgctgcatgcctaccgtgcctgcctgaacatgggcaccctggtcggcgcgccgaaggtccgtgccatgcagttgctgcggcagtacgaggatggctatcgcggcagctacggtggtgcgatcggcattctcgacagcgccggcaacctcgataccagcattgtcatccgctccgccgaggtccgcgaaggtatcgcgcgggttcgggcaggcgccggcgtggtgctggattcggatccacggctggaggccgaggaaacccgcaacaaggcgctggcggtgctgaccgccgtggccgctgccgaacgcgaaaggggagagcgcgatgcgcatcacgctgttggataacttcgattccttcacctacaacctggtcgagcagttctgcctgctcggcgcggaggtccgggtgatgcgcaacgatacgccgttgccgacgatccaggcggcattgctggccgacggttgcgaactgctggtgctgtcgccggggcccggtcggccggaagacgccggctgtatgctggaattgctcgcctgggcccgcgggcgcttgccggtgctcggcgtctgcctcggccaccaggcgctggcgctggccgccggtggcgcggtgggcgaggcgaggaagccgctgcatggcaagagcacgtccctgcgtttcgatcagcgtcacccgctgttcgacggcatcgctgacctgcgcgtcgcgcgctaccactcgctggtggtcagtcgcctgccggaaggtttcgactgcctggccgatgccgatggcgagatcatggcgatggccgatccgcgcaatcgacagctgggcttgcaattccatcccgagtcgattctcaccacccacggccagcgtctgctggagaacgctctactctggtgcggcgcgttggcggtcgcggagcgccttcgggcctgagcggcgctgcgcagtttcgaccgaggctcggttgccaggccggcgcatcgtcgaaacgctggcggcccagttcgcgcaggcgctggcgggcgctttcgagaaagcgacggaagctgcgctcggattccagcgcggtgttgtagtagcaatacaccttggtgtcgatgccgcccggttcgtacagttcgctgaggactgccagggtaccgttgcgcaggcgttcctcgacgaaataatgcggcgagatgccccatccgacgccggcttccaccagacgcagcatgtcgtcgaagttttccacgaagagcaccttgtcgctgaccggccgcagcaggttcgaatgctgcccggagcggctgccgaggctgatctgccggtaattggccaggctcgcgatgctgtgcagggaggcattgcacaacgggtgctgcggatgggcgacgacgaacgccttggtgtagccgagcacgcactggttgaagcgggagatct

SEQ ID NO: 130 - protein, 530 aa, Pseudomonas aeruginosa
MGARRWLVSGVGYRLEESLEYRTLVPEALSIWRMAGANRMLFDCFDVDSKAARRSVAILSSCLRIECWGRDVVLRALNSNGRALLAPLSEDCPAQVTCLRDGDTLHWRFPQEESHADEWRRLHGLSSLEALRRVLGTLGDAEGPVLLGGLFSFDLAEQFEPLPAPAEPARHCPDYLFLVPELLLDIDHLARRTSLQAFVHDPAGHDRLAASLRQCADEFHGAVEEASESPVAGVRAGNYQVDLDDASFARQVERLQAHVRAGDVFQIVPSRSFSMPCADPWRAYRQLCLRNPSPYRFFLDAGDFCLFGASPESALKYDAESREVELYPIAGTRPRGRDARGAIDAELDNRLEAELRLDAKEIAEHMMLVDLARNDLARVCRSGTRQVRDMLKVDRYSHVMHLVSRVAGELHGELDALHAYRACLNMGTLVGAPKVRAMQLLRQYEDGYRGSYGGAIGILDSAGNLDTSIVIRSAEVREGIARVRAGAGVVLDSDPRLEAEETRNKALAVLTAVAAAERERGERDAHHAVG

SEQ ID NO: 131 - DNA, 1436 bp, Pseudomonas aeruginosa
cgtccgattcggcctgagtctttctcttccctcgaacatcacgggagctgtagtcgatgcataccctaaaacgctgtatggctgcgatggtggccttgctggccttgagcctggcgatgacggcccgggcagaactgccggacttcacgcctttggtcgaacaggcgtcgccggcggtggtgaatatcagtacgcggcagaagctgccggatcgcgccatggcgcgcgggcagctgtcgatccccgacctcgaagggctgccgccgatgttccgcgacttcctcgagcgcacgatcccgcaggttccgcgcaatccgcgcggccagcagcgcgaggcgcaatcgctgggctccggcttcatcatctccaacgacggctacatcctcaccaacaatcacgtcgtggccgatgccgacgagatcctggtgcgcctgtccgaccgtagcgagcacaaggccaagctggtcggcgcggacccgcgcagcgacgtggcggtgctgaagatcgaggcgaagaacctgccgaccctgaaactgggcgattcgaacaagctgaaagtgggcgaatgggtcctggccatcggttcgccgttcggcttcgatcactcggtcaccgccggtatcgtcagtgccaaggggcgtagcctgccgaacgagagctacgtacccttcatccagaccgacgtggcgatcaacccgggcaactccggcggtccgctgctgaacctggagggcgaagtggtcggcatcaactcgcagatcttcacccgttccggcggcttcatgggcctgtccttcgccatcccgatcgatgtcgcgctgaacgtcgccgaccagttgaagaaagccggcaaggtcagccgcggctggctgggtgtggtgatccaggaagtgaacaaggatctcgccgagtccttcggcctcgacaagccgtccggcgcgctggtggcgcagctggtggaagacggtccggcggccaagggcggcctgcaggtgggcgatgtgatcctcagcctgaacggccagtcgatcaacgagtccgccgacctgccgcacctggtgggcaacatgaagccgggcgacaagatcaacctggacgtgattcgcaacggccagcgcaagtccttgagcatggcggtaggcaaccttccggacgacgacgaggaaatcgcctcgatgggcgctccgggcgccgagcgcagcagcaaccgcctgggcgtgaccgtcgccgacctgaccgccgagcagcgcaagagcctggatatccagggcggcgtggtgatcaaggaagtccaggacggtccggccgcggtcatcggcctgcgtccgggcgatgtcatcacccacctggacaacaaggcggtgacctcgaccaagatcttcgccgacgtggccaaggccctgccgaagaaccgttcggtttcgatgcgggtactg

SEQ ID NO: 132 - protein, 460 aa, Pseudomonas aeruginosa
MHTLKRCMAAMVALLALSLAMTARAELPDFTPLVEQASPAVVNISTRQKLPDRAMARGQLSIPDLEGLPPMFRDFLERTIPQVPRNPRGQQREAQSLGSGFIISNDGYILTNNHVVADADEILVRLSDRSEHKAKLVGADPRSDVAVLKIEAKNLPTLKLGDSNKLKVGEWVLAIGSPFGFDHSVTAGIVSAKGRSLPNESYVPFIQTDVAINPGNSGGPLLNLEGEVVGINSQIFTRSGGFMGLSFAIPIDVALNVADQLKKAGKVSRGWLGVVIQEVNKDLAESFGLDKPSGALVAQLVEDGPAAKGGLQVGDVILSLNGQSINESADLPHLVGNMKPGDKINLDVIRNGQRKSLSMAVGNLPDDDEEIASMGAPGAERSSNRLGVTVADLTAEQRKSLDIQGGVVIKEVQDGPAAVIGLRPGDVITHLDNKAVTSTKIFADVAKALPKNRSVSMRVL

SEQ ID NO: 133 - DNA, 1341 bp, Pseudomonas aeruginosa
gcgcgacaaacaatcgaggtgaatgcgatgcgaatcagcatctttggtttgggctatgtcggtgcagtatgtgctggctgcctgtcggcacgcggtcatgaagtcattggtgtggatgtctccagcaccaagatcgacctgatcaaccagggcaagtcgcccatcgtcgaaccgggcctggaagcgttgttgcagcaaggccggcagaccggacggctgtcgggcaccaccgacttcaagaaggctgtgctggactccgacgtatcgttcatctgcgtcggcacgccgagcaagaagaacggcgacctggacctgggctacatcgagaccgtctgccgcgagatcggcttcgccatccgcgagaagtccgaacgccacaccgtggtggtgcgcagcaccgtactgccgggcaccgtcaacaacgtggtgatcccgctgatcgaggactgctcgggcaagaaggccggggtcgacttcggcgtcggcaccaaccccgaattcctccgcgagagcaccgcgatcaaggactacgacttcccgccgatgaccgtgatcggcgaactggacaagcagaccggcgaccttctcgaggaaatctaccgcgagctggacgcgccgatcatccgcaagaccgtcgaggtcgccgagatgatcaagtacacctgcaacgtctggcacgccgccaaggtcaccttcgccaacgagatcggcaacatcgccaaggcggtcggcgtcgacggccgcgaggtgatggacgtgatctgccaggaccacaagctcaacctgtcgcgctactacatgcgtcccggcttcgccttcggcggctcctgcctgcccaaggatgtacgcgccctcacctatcgcgccagccagctggacgtcgagcacccgatgctcggttcgttgatgcgcagcaactccaaccaggtgcagaaggccttcgatctcatcaccagccacgacacccgcaaggtcggcctgctcggcctgtcgttcaaggccggcaccgacgatttgcgcgaaagcccgctggtggagctggccgagatgctcatcggcaagggctacgagttccgcatcttcgaccgcaacgtcgaatacgcgcgtgtccacggggccaacaaggaatacatcgagtcgaagatcccgcacgtctcctcgctgctggtctccgacctcgacgaagtggtggcgagttccgatgtgctggtgctgggcaatggcgacgagctgttcgtcgacctggtgaacaagaccccgagcggcaagaagctggtcgacctggtgggcttcatgccgcacaccaccactgcccaggccgagggcatctgctggtagcgg

SEQ ID NO: 134 - protein, 436 aa, Pseudomonas aeruginosa
MRISIFGLGYVGAVCAGCLSARGHEVIGVDVSSTKIDLINQGKSPIVEPGLEALLQQGRQTGRLSGTTDFKKAVLDSDVSFICVGTPSKKNGDLDLGYIETVCREIGFAIREKSERHTVVVRSTVLPGTVNNVVIPLIEDCSGKKAGVDFGVGTNPEFLRESTAIKDYDFPPMTVIGELDKQTGDLLEEIYRELDAPIIRKTVEVAEMIKYTCNVWHAAKVTFANEIGNIAKAVGVDGREVMDVICQDHKLNLSRYYMRPGFAFGGSCLPKDVRALTYRASQLDVEHPMLGSLMRSNSNQVQKAFDLITSHDTRKVGLLGLSFKAGTDDLRESPLVELAEMLIGKGYEFRIFDRNVEYARVHGANKEYIESKIPHVSSLLVSDLDEVVASSDVLVLGNGDELFVDLVNKTPSGKKLVDLVGFMPHTTTAQAEGICW

SEQ ID NO: 135 - DNA, 1723 bp, Pseudomonas aeruginosa
aacaccggacgcgccccgatcatgtgcgctgagcgctacgctaccgtcaacgaaaaaggccacctcggggtggccttttcgcgttctcgcaccgatcgcgcggaatatcggcggttaacgcctctcccccgtgcgcacctgcggctgagcctcagaacgaagtccggcggtaggcacggtagcgcgggaaccagaagttcgcctcgatggcgtcgttcagtacctcgtcgctggtatgcagggccttgccctcggcctgggcctgcttggccacggcgacggcgatgcgcttgctgacctcgcggatgtcgcccagcgccggcaacacggcgccctcgccctgggtaacgatcggcgagcagttggccagggcgttggccgcggccatcagcatgccttcggtgacccgattggcccgcgcggcgatcacccccaggccgatgccggggaagatataggcgttgttgcactgggcgatgggaatccgcttgtcgcccacctgcaccggttggaacgggctaccggtggcgaccagcgcctggccgtcggtccagttgaggatttcctgcggagtcgcctcgacccgcgaggtcgggttggacagcggcatcaccagcggctgcttgcaatggctgtgcagctcacggatgacctcttcggaaaacagcccgcgctgcccggagacgccgatcagcaccgtcggccgggcattgcggatcacttccagcaacgccaggtcgtcgccctgctggccgccccaggcaccgagatcggcgcgcttctgcgccaggcggtgctggaagtcgaccaggttgctcatgtcgtcggtgagcaggccccagcggtcgaccatgaagatgcgccgacgcgcctgggcctcgtccaggccctccagttgcatggcggcgatgatctgttcggcgatgccgcaaccggcggaggggcgccgacgaaggtcacggtctgctcgctgagcttctcgcccttggccttgcaagccgccagcagggtgcccacggccaccgcggcggtgccctggatgtcgtcgttgaagcagcacagctcgtccttgtagcgctccagcaacggcatggcattggtctgggcgaagtcctcgaattgcagcaggacgttgggccagcggcgcttgatcgcctggatgaacaggtcgacgaactcctcgtactgcgccccgctcacccgctcgtggcgccacccaatgtacatcgggtcgttgagcaggtccgggttgttggtgccgacgtccagcaccaccggcagggtgtaggccgggctgataccgccgcaggtgtaacaggggacagcttgccgatcgggatgcccatccggccgatgccctggttgccgagggcgaggatcggctggctgtcggtacaaaacaatctaaggtgtctttggtggcttgaaggagtttcaatcgttcgggccgggaagaataaaggcccggtgggtcgaaactttgaatctggaaggttgcaaactgggggaaaaaatggaaatttttaagagcctaagagcggaaaaaagttctttttctaaaaagaaaaaaatggggaaaaagttgaaaagtatatgataagagcaggtgtcaaaatgaatgttttgaaagcccagtgaaataaactctggaaaaggcagttataagggctataaaagggatgaaaaaagaagtgtgtgaaataacgaaaggcaatagggaaaa

SEQ ID NO: 136 - DNA, 2048 bp, Pseudomonas aeruginosa
agcttatgcatgcggccgcatctagagggcccggatccggtgaccatcggtcaccggcatgccggtggtttcggtatccagtacgacgctacgcatctatagagcctttctctgtttcgctgcagccgtggctgctgaacgcttgtttcggtgtggccgctcagcgcggcaattcggcgacgccacggttggccaactggtcggcccgctcgttgccggggtcgccggtatgcccgcggacccactgccactccacctggtgccgggcgacctgttcatccagggcctgccagaggtcggcattcttgacaggctgcttgctggcggtcttccagccgcgcttcttccagttcggcaaccattcggtgatgccgcgcatcacgtattccgagtcggtgatcagacggatcggacaggaacgcttgagtgccgccagcgcctggatcgccgccatcagctccatgcggttgttggtggtgtccggctcgccgccccaaagctctcgctcggcgcccttgtagaggagcaacgccccccagccgccgcgcccagggttgcccttgcaggcgccgtcggtatagatcactacctgttctttatctgtcatgcctaaatttcggaatctcgccggctgactttcgccaccggcatgggcaccagctgaccgcgcggttcgcgcttgctctggcgcaacgggcgcaaccccacgaccagcttgcgtgccaccaatagatagaagccggcgcccgaagactgccaggcgtcgccccagcgctccaggcgagccaggcgcgattgccaggctgccgacgcaagcggcggacgatagcacccgaagcgccgtttctccagcgcgaagcccagcaggttgagccaatcgcaggcccgcgacggaggaatgcagcgggcctggcgcaaggcatccccggcgaaataatgacggatgccccacaggctccatgggttgatgccgatcagcagcaggtggccgcccggacgaacggtacgcgcggcttcgcgcaggagacggtgaggcgacaggcagaaatccaggccgtgttgcagcaggaccacgtccgcggcatgttcgctgagcggccaggcgccctcttcgcaggcgatgtccacgcccggcagcggcggccccaggcgcacgccgcgctgaatctgcccggtgctcggcggcagttcggcatgcggcccgtagtgcaccaggtagccaccgaagtaacgggtcagctcgtcgcacaacaggcgtcgctcctcggccagcatcaggctgcccagcgggccctggaaccagtcgcgcgcccggttgatcgatgccagccactcggcatcggtctgggcgaaggcttgcggttcgttcatgcgtacctccagcgtcttccccttcgcggcgacggacgccggcacgacgggaaaataagcaatactatgcgccaatgacttctgcttagcgacatcgacccatgatacagatcgacgccctgcccgccttcaacgacaactacatctggctgttgcaagatgcgacaagccgtcgctgcgcggtggtcgaccccggcgatgccaagccggtggaagcctggctggccgcccatcccgactggcggttgagcgatatcctggtgacccaccaccatcacgaccacgtcggcggcgtcgcggccctgaaggaactgaccggcgcgcgggttctcggcccggccaacgagaagatcccggcccgcgacctggcgctggaagacggcgaacgggtcgaggtgctcggcctggtcttcgagatcttccacgtgcccggccataccctcggccatatcgcctactaccacccggcggagacgccgctgctgttctgcggcgacaccctgttcgccgccggctgcggccgtctcttcgaaggcaccccggcgcagatgcaccattccctggcgcgactggccgcgctgccggccaacacccgggtctactgcacccacgagtacacgctgagcaacctgcgcttcgcgctggcggtggagcccgacaacgcggcgctgcgggaa

SEQ ID NO: 137 - DNA, 144 bp, Pseudomonas aeruginosa
  variation (1)...(144): N is any nucleic acid.
nttgtgttaagatcaggcttggtggtgaagaaaggttcgaacnngtggtcaatgatcnacttcggggatncngctgcccgtatnattcaacacgtggtcaaacggtatgttccgaggcgtctgnccaccngtactagtcgacgc

SEQ ID NO: 138 - DNA, 18 bp, Pseudomonas aeruginosa
aatatcgccctgagcagc

SEQ ID NO: 139 - DNA, 20 bp, Pseudomonas aeruginosa
aatacactcactatgcgctg

SEQ ID NO: 140 - DNA, 18 bp, Pseudomonas aeruginosa
ccatctcatcagagggta

SEQ ID NO: 141 - DNA, 20 bp, Pseudomonas aeruginosa
cgttaccatgttaggaggtc

SEQ ID NO: 142 - DNA, 24 bp, Pseudomonas aeruginosa
cgcatcgtcgaaacgctggcggcc

SEQ ID NO: 143 - DNA, 24 bp, Pseudomonas aeruginosa
gccgatggcgagatcatggcgatg

SEQ ID NO: 144 - DNA, 29 bp, Pseudomonas aeruginosa
tgcgcaacgatacgccgttgccgacgatc

SEQ ID NO: 145 - DNA, 24 bp, Pseudomonas aeruginosa
gattccaccttcgcagcgcagccc

SEQ ID NO: 146 - DNA, 24 bp, Pseudomonas aeruginosa
gattccaccttcgcagcgcagccc

SEQ ID NO: 147 - DNA, 24 bp, Pseudomonas aeruginosa
gccgatggcgagatcatggcgatg

SEQ ID NO: 148 - DNA, 1008 bp, Pseudomonas aeruginosa
ggccaggcaaacgcgatggccaccgtgcaacagctcgacccgatctacgtcgacgtcacccagccgtccaccgccctgttgcgcatgcgccgcgaactggccagcggccagttggagcgcgccggcgacaacgctgcgaaggtctccctgaagctggaggacggtagccaatacccgctggaaggccgcctcgaattctccgaggtttccgtcgacgaaggcaccggctcggtcaccatccgcgccgtgttccccaacccgaacaacgagctgctgcccggcatgttcgttcacgcgcagttgcaggaaggcgtcaagcagaaggccatcctcgctccgcagcaaggcgtgacccgcgacctcaagggccaggctaccgcgctggtggtgaacgcgcagaacaaggtcgagctgcgggtgatcaaggccgaccgggtgatcggcgacaagtggctggtcaccgaaggcctgaacgccggcgacaagatcattaccgaaggcctgcagttcgtgcagccgggtgtcgaggtgaagaccgtgccggcgaagaatgtcgcgtccgcgcagaaggccgacgccgctccggcgaaaaccgacagcaagggctgatcaaggggattcgtaatgtcgaagtttttcattgataggcccattttcgcgtgggtgatcgccttggtgatcatgctcgcgggcggcctgtcgatcctcaatctgccggtcaaccagtacccggccatcgccccgccggccatcgccgtgcaggtgagctacccgggcgcctcggccgagacggtgcaggacaccgtggtccaggtgatcgagcagcagatgaacgggatcgacaatctgcgctacatctcctcggagagtaactccgacggcagcatgaccatcaccgtgaccttcgaacagggcaccgaccccgacatcgcccaggtccaggtgcagaacaagctgcaactggccaccccgctgctgccgcaggaagtgcagcgccaggggatccgg

SEQ ID NO: 149 - protein, 202 aa, Pseudomonas aeruginosa
GQANAMATVQQLDPIYVDVTQPSTALLRMRRELASGQLERAGDNAAKVSLKLEDGSQYPLEGRLEFSEVSVDEGTGSVTIRAVFPNPNNELLPGMFVHAQLQEGVKQKAILAPQQGVTRDLKGQATALVVNAQNKVELRVIKADRVIGDKWLVTEGLNAGDKIITEGLQFVQPGVEVKTVPAKNVASAQKADAAPAKTDSKG

SEQ ID NO: 150 - protein, 128 aa, Pseudomonas aeruginosa
MSKFFIDRPIFAWVIALVIMLAGGLSILNLPVNQYPAIAPPAIAVQVSYPGASAETVQDTVVQVIEQQMNGIDNLRYISSESNSDGSMTITVTFEQGTDPDIAQVQVQNKLQLATPLLPQEVQRQGIR

SEQ ID NO: 151 - DNA, 372 bp, Pseudomonas aeruginosa
cgacgtccagccggcctgaaccgtcggtcgctgcgcccttcccaagcggggagggcggtagcaaggttcattcgtccaatcaccgcgtcgcccacgagaccgccatgcaaatcaaactcgccaatccccgcggcttctgcgccggcgtggatcgcgccatcgagatcgtcaaccgtgccctcgatgtcttcggcccgccgatctacgtgcgtcacgaggtggtgcacaacaagttcgtcgtggacaacctgcgccagcgcggcgccatcttcgtcgaggaactcgatcaggtgccggacaacgtcatcgtcatcttcagcgcccacggcgtttcccaggcggtccgcaaggaagccgaggggcgcggcctga

SEQ ID NO: 152 - protein, 123 aa, Pseudomonas aeruginosa
RRPAGLNRRSLRPSQAGRAVARFIRPITASPTRPPCKSNSPIPAASAPAWIAPSRSSTVPSMSSARRSTCVTRWCTTSSSWTTCASAAPSSSRNSIRCRTTSSSSSAPTAFPRRSARKPRGAA

SEQ ID NO: 153 - DNA, 762 bp, Pseudomonas aeruginosa
atgaacgaaccgcaagccttcgcccagaccgatgccgagtggctggcatcgatcaaccgggcgcgcgactggttccagggcccgctgggcagcctgatgctggccgaggagcgacgcctgttgtgcgacgagctgacccgttacttcggtggctacctggtgcactacgggccgcatgccgaactgccgccgagcaccgggcagattcagcgcggcgtgcgcctggggccgccgctgccgggcgtggacatcgcctgcgaagagggcgcctggccgctcagcgaacatgccgcggacgtggtcctgctgcaacacggcctggatttctgcctgtcgcctcaccgtctcctgcgcgaagccgcgcgtaccgttcgtccgggcggccacctgctgctgatcggcatcaacccatggagcctgtggggcatccgtcattatttcgccggggatgccttgcgccaggcccgctgcattcctccgtcgcgggcctgcgattggctcaacctgctgggcttcgcgctggagaaacggcgcttcgggtgctatcgtccgccgcttgcgtcggcagcctggcaatcgcgcctggctcgcctggagcgctggggcgacgcctggcagtcttcgggcgccggcttctatctattggtggcacgcaagctggtcgtggggttgcgcccgttgcgccagagcaagcgcgaaccgcgcggtcagctggtgcccatgccggtggcgaaagtcagccggcgagattccgaaatttag

SEQ ID NO: 154 - DNA, 801 bp, Pseudomonas aeruginosa
atggagcctgtggggcatccgtcattatttcgccggggatgccttgcgccaggcccgctgcattcctccgtcgcgggcctgcgattggctcaacctgctgggcttcgcgctggagaaacggcgcttcgggtgctatcgtccgccgcttgcgtcggcagcctggcaatcgcgcctggctcgcctggagcgctggggcgacgcctggcagtcttcgggcgccggcttctatctattggtggcacgcaagctggtcgtggggttgcgcccgttgcgccagagcaagcgcgaaccgcgcggtcagctggtgcccatgccggtggcgaaagtcagccggcgagattccgaaatttaggcatgacagataaagaacaggtagtgatctataccgacggcgcctgcaagggcaaccctgggcgcggcggctggggggcgttgctcctctacaagggcgccgagcgagagctttggggcggcgagccggacaccaccaacaaccgcatggagctgatggcggcgatccaggcgctggcggcactcaagcgttcctgtccgatccgtctgatcaccgactcggaatacgtgatgcgcggcatcaccgaatggttgccgaactggaagaagcgcggctggaagaccgccagcaagcagcctgtcaagaatgccgacctctggcaggccctggatgaacaggtcgcccggcaccaggtggagtggcagtgggtccgcgggcataccggcgaccccggcaacgagcgggccgaccagttggccaaccgtggcgtcgccgaattgccgcgctga

SEQ ID NO: 155 - DNA, 513 bp, Pseudomonas aeruginosa
atgacggatgccccacaggctccatgggttgatgccgatcagcagcaggtggccgcccggacgaacggtacgcgcggcttcgcgcaggagacggtgaggcgacaggcagaaatccaggccgtgttgcagcaggaccacgtccgcggcatgttcgctgagcggccaggcgccctcttcgcaggcgatgtccacgcccggcagcggcggccccaggcgcacgccgcgctgaatctgcccggtgctcggcggcagttcggcatgcggcccgtagtgcaccaggtagccaccgaagtaacgggtcagctcgtcgcacaacaggcgtcgctcctcggccagcatcaggctgcccagcgggccctggaaccagtcgcgcgcccggttgatcgatgccagccactcggcatcggtctgggcgaaggcttgcggttcgttcatgcgtacctccagcgtcttccccttcgcggcgacggacgccggcacgacgggaaaataagcaatactatgcgccaatga

SEQ ID NO: 156 - protein, 253 aa, Pseudomonas aeruginosa
MNEPQAFAQTDAEWLASINRARDWFQGPLGSLMLAEERRLLCDELTRYFGGYLVHYGPHAELPPSTGQIQRGVRLGPPLPGVDIACEEGAWPLSEHAADVVLLQHGLDFCLSPHRLLREAARTVRPGGHLLLIGINPWSLWGIRHYFAGDALRQARCIPPSRACDWLNLLGFALEKRRFGCYRPPLASAAWQSRLARLERWGDAWQSSGAGFYLLVARKLVVGLRPLRQSKREPRGQLVPMPVAKVSRRDSEI

SEQ ID NO: 157 - protein, 266 aa, Pseudomonas aeruginosa
MEPVGHPSLFRRGCLAPGPLHSSVAGLRLAQPAGLRAGETALRVLSSAACVGSLAIAPGSPGALGRRLAVFGRRLLSIGGTQAGRGVAPVAPEQARTARSAGAHAGGESQPARFRNLGMTDKEQVVIYTDGACKGNPGRGGWGALLLYKGAERELWGGEPDTTNNRMELMAAIQALAALKRSCPIRLITDSEYVMRGITEWLPNWKKRGWKTASKQPVKNADLWQALDEQVARHQVEWQWVRGHTGDPGNERADQLANRGVAELPR

SEQ ID NO: 158 - protein, 170 aa, Pseudomonas aeruginosa
MTDAPQAPWVDADQQQVAARTNGTRGFAQETVRRQAEIQAVLQQDHVRGMFAERPGALFAGDVHARQRRPQAHAALNLPGARRQFGMRPVVHQVATEVTGQLVAQQASLLGQHQAAQRALEPVARPVDRCQPLGIGLGEGLRFVHAYLQRLPLRGDGRRHDGKISNTMRQ

SEQ ID NO: 159 - DNA, 759 bp, Pseudomonas aeruginosa
atgcggcgagatgccccatccgacgccggcttccaccagacgcagcatgtcgtcgaagttttccacgaagagcaccttgtcgctgaccggccgcagcaggttcgaatgctgcccggagcggctgccgaggctgatctgccggtaattggccaggctcgcgatgctgtgcagggaggcattgcacaacgggtgctgcggatgggcgacgacgaacgccttggtgtagccgagcacgcactggttgaagcgggagatcttcagttcctcgtcgatggtgatggcgatatcgatttccgcgttgtcctgcttgatcgtcgccaggctatcggcgggcgaggtgcgtatcaggctgaccatgttgaaatcgtcgagcagtacgctgctcaccgtatcgcagaacgacggcgggatggcggtgtccagcagcacccggagattgcgcggacccttgttgagattgaaggcgatgtcgccgatcagctgctggtagttcagcaggctgcgcatgtaagggatcaggcgaagcgcctgctcggtgggttcgaccttgtagccgtcccgacggaccagctccacgcacaggtcgatttccaggttgctgaccgccgagctgaccgcggtgtgcgacttgcgcaggatccgcgcagcggaggaaatcgaaccggaggcgatgacctggaggaacatgttcacgtgattcaggttatgaataggcatcccttattccttttattgggtggcgcgtgccgcttcccttga

SEQ ID NO: 160 - DNA, 1299 bp, Pseudomonas aeruginosa
tatggatgccagtcgattcgaactggcggagattcgcaccatgcgagagtaccaacggttgaaagggtttaccgacaacctggaattgcggcggcgcaaccgtgccacggtcgagcactacatgcgcatgaagggggccgaacggttgcagcggcacagcctgttcgtcgaggacggctgcgccggcaactggaccacggaaagcggcgaacccctggttttccggggccatgagagcctcaggcggctcgccgagtggctcgagcgctgcttccccgactgggagtggcacaacgtgcggatcttcgagaccgaggatccgaaccacctctgggtcgagtgcgacgggcgcggcaaggcgctggtcccggggtatccgcagggctattgcgagaaccactacatccattccttcgaactcgagaacggccggataaaacgcaatcgcgagttcacgaacccgatgcagaaattgcgtgcattgggaatagccgttccgcaaataaaacgtgacggcattcccacctgattaatgattattccaattcaagaggagatatgacgatgctcgataatgctattccccaaggtttcgaagacgccgtggagttgcgcaggaagaatcgcgagacggtggtcaagtatatgaacaccaaaggccaggatcgcctgcgccgccatgaacttttcgtcgaggacggctgtggcggtttatggaccaccgataccggctcgcccatcgtcattcgtggcaaggacaagctggccgagcacgcggtgtggtcgctgaaatgcttcccggattgggagtggtacaacatcaaggtcttcgagaccgacgatcccaaccacttctgggtcgagtgcgacggccacggcaagatcctcttccccgggtatcccgagggttactacgagaaccacttcctgcattccttcgagctggacgacggcaagatcaagcgcaaccgcgaattcatgaacgtcttccagcaattgcgcgccctgagcattccggtcccgcagatcaaacgcgaaggcattcccacctgaggccatcctggaaggggtgaactatggacgatctattgcaacgcgtacggcgctgcgaagcgctgcagcaacccgaatggggcgatccgtcgcgcctgcgcgacgtgcaggcgtacctgcgcggcagtccggcgctgatccgcgccggcgacatcctggccctgcgcgcgaccctggccgggtcgcccgcggcgaggcgctggtggtgcagtgcggcgactgcgccgaggacatggacgaccacca

SEQ ID NO: 161 - protein, 162 aa, Pseudomonas aeruginosa
MREYQRLKGFTDNLELRRRNRATVEHYMRMKGAERLQRHSLFVEDGCAGNWTTESGEPLVFRGHESLRRLAEWLERCFPDWEWHNVRIFETEDPNHLWVECDGRGKALVPGYPQGYCENHYIHSFELENGRIKRNREFTNPMQKLRALGIAVPQIKRDGIPT

SEQ ID NO: 162 - protein, 162 aa, Pseudomonas aeruginosa
MLDNAIPQGFEDAVELRRKNRETVVKYMNTKGQDRLRRHELFVEDGCGGLWTTDTGSPIVIRGKDKLAEHAVWSLKCFPDWEWYNIKVFETDDPNHFWVECDGHGKILFPGYPEGYYENHFLHSFELDDGKIKRNREFMNVFQQLRALSIPVPQIKREGIPT

SEQ ID NO: 163 - protein, 74 aa, Pseudomonas aeruginosa
MDDLLQRVRRCEALQQPEWGDPSRLRDVQAYLRGSPALIRAGDILALRATLAGSPAARRWWCSAATAPRTWTTT

SEQ ID NO: 164 - DNA, 1161 bp, Pseudomonas aeruginosa
cgtcgacgaggcccgccatgggccaaggtttgttgtcgggaggcgctcccgacgacgatggagcgtgcgagaagaacaatgagaaagaccgccgtgaggcccatcggagagccgttctacggtttccgcaaagatccggggcgccgtcccctccagcacagcgcagttcctgcgcggcgcctcgtgtccgtgctcatcgagaagttctcttcagcctcgtttcgtcgtcgcccggcgggcggcgaatgggctcgacctcgtccggaacacccgcacagggccggtggcgatatgtacttccaggtccggcttgataaagggaattgtcatgagtggataagacggaaacaaaaaagaataaaaacgctgaagaaccgaatcctgccgggatcgattgttgactggtgaagctggcatgcatgatgagagagagggatatctcgagattttgtcaagaataacaaccgaggaagagttcttctccctggttctcgagatatgcggtaattatggattcgaattcttttcattcggtgcgcgggcgcctttcccgctgaccgcgcctaaatatcatttcctgtccaattacccaggggaatggaaaagcagatatatctccgaagactacacatccatcgacccgatcgtgcgccatggtctcctggaatacaccccgctgatctggaatggcgaagacttccaggagaaccgtttcttctgggaggaagcgctgcatcacggcatccgtcacggctggtcgatcccggtccgcggcaagtacgggctgatcagcatgctgtccctggtgcgttccagcgagagcatcgccgctacggaaatcctggagaaggaatccttcctgctctggatcaccagcatgctgcaggctaccttcggcgacctgctggcgccgcgcatcgtcccggaaagcaatgtgcgcctgaccgccagggaaaccgagatgctcaagtggaccgcggtgggcaagacctacggcgagatcggcctgatcctgtcgatcgaccagcgcacggtgaaattccatatcgtcaatgcgatgcgcaagctcaactccagcaacaaggcggaggccaccatgaaggcctacgccatcggcctgctcaactgaatcgacgcctcgtcgcctagcgaggccgccgc

SEQ ID NO: 165 - protein, 238 aa, Pseudomonas aeruginosa
MHDEREGYLEILSRITTEEEFFSLVLEICGNYGFEFFSFGARAPFPLTAPKYHFLSNYPGEWKSRYISEDYTSIDPIVRHGLLEYTPLIWNGEDFQENRFFWEEALHHGIRHGWSIPVRGKYGLISMLSLVRSSESIAATEILEKESFLLWITSMLQATFGDLLAPRIVPESNVRLTARETEMLKWTAVGKTYGEIGLILSIDQRTVKFHIVNAMRKLNSSNKAEATMKAYAIGLLNZ

SEQ ID NO: 166 - DNA, 633 bp, Pseudomonas aeruginosa
atgcgtaacctgattctcaccgccatgctggccatggccagcctgttcggcatggccgcccaggccgacgactataccgccggcaaggaatacgtcgagctgagcagcccggtgccggtgtcccagccgggcaagatcgaagtggtggaactgttctggtatggctgcccgcattgctacgcgttcgagccgaccatcgtgccgtggagcgagaagctgccggcagatgtccatttcgtgcgcctgcctgccctgttcggcggtatctggaacgtccatgggcagatgttcctgaccctggaaagcatgggtgtcgagcatgacgtccacaacgccgtgttcgaggcgatccacaaggagcacaagaagctcgccactccggaagagatggccgatttcctcgccggcaagggcgtggacaaggaaaaattcctgagcacctataattcctttgccatcaagggccagatggaaaaggccaagaagctggcgatggcctaccaggtcaccggcgtaccgaccatggtggtcaatggcaaataccgcttcgacatcggctccgccggtggtccggaggaaaccctcaagctggccgactacctgatcgagaaagagcgcgcggccaagaagtag

SEQ ID NO: 167 - protein, 210 aa, Pseudomonas aeruginosa
MRNLILTAMLAMASLFGMAAQADDYTAGKEYVELSSPVPVSQPGKIEVVELFWYGCPHCYAFEPTIVPWSEKLPADVHFVRLPALFGGIWNVHGQMFLTLESMGVEHDVHNAVFEAIHKEHKKLATPEEMADFLAGKGVDKEKFLSTYNSFAIKGQMEKAKKLAMAYQVTGVPTMVVNGKYRFDIGSAGGPEETLKLADYLIEKERAAKK

SEQ ID NO: 168 - DNA, 3010 bp, Pseudomonas aeruginosa
gaaaagggccagacgcacggggtgactccatcggttggcgggtggcgggagggccgcgagagccttttgcgaaggctcccaccgggccttgggaaaacccctagcctaccggcttttgccggccctgtatcctccccgcacgagtcgcaaagccgcgcgttgccgctatcacaagctttatggaacaatgcgggcacatgcgatttcgaggatgtcccagcgtgatcgattccgatggttttcgcccgaatgtcggcatcattctcgccaacgaggcggggcaggtgctgtgggcgcggcgtatcaatcaggaagcctggcagttcccgcagggaggcatcaatgatcgcgaaacgccggaagaggcgctgtatcgcgaattgaacgaagaagtcgggctggaggccggggacgtgcgcatcctggcctgcacccgcggctggctgcgctaccgtttgccgcagcgcctggtgcggacccacagccagccgctgtgcatcggccagaagcagaaatggttcctgctgcggctgatgtccgacgaggcgcgcgtgcgcatggatatcaccagcaagcccgagttcgacggctggcgctgggtgagttactggtaccccctgggacaggtggtgaccttcaagcgcgaggtctaccgccgcgccctgaaggaactggccccgcgccttctggcgcgggactgaacacggagacaaggccccgagcatgctcaacacgctgcgcaagatcgtccaggaagtgaactccgccaaggatctgaaggcggcgctgggcatcatcgtgcagcgggtcaaggaagccatgggtacccaggtctgctcggtgtacctgctcgacaccgagacccagcgtttcgtcctgatggccaccgaaggcctcaacaagcgttccatcggcaaggtcagcatggcccccagcgaaggcctggtcggcctggtcggcacccgcgaggagccgctcaacctggagaacgccgccgcccacccgcgctaccgctatttcgccgagaccggcgaggagcgctacgcgtcgttcctcggcgcgccgatcatccaccataggcgggtgatgggggtgctggtggtgcagcagaaggagcgccgccagttcgacgaaggcgaggaggccttcctcgtcaccatgagcgcccagctcgccggggtcatcgcgcatgccgaggcgaccggttcgatccgcggcctgggcaagctcggcaagggcatccaggaagccaagttcgtcggcgtgcccggcgcccccggggtcggggtgggcaaggcggtggtggtgttgcctccggccgacctggaagtggtgccggacaagcaggtcgacgacatcgacgccgagatcgccctgttcaagcaggccctggagggcgttcgcgccgacatgcgcgcgctgtcgagcaagctcgccagccagttgcgcaaggaagaacgcgcgctgttcgacgtctacctgatgatgctcgacgatgcctccatcggcaacgaggtcaagcgcatcatccgtaccggccagtgggcccagggcgccctgcgccaggtggtgatggagcacgtgcagcgcttcgagctgatggacgacgcctatctccgcgagcgcgcctccgacgtcaaggacatcggtcgccgcctgctcgcctacctgcaggaagaacgcaagcagaacctgacctacccggagcagaccatcatcgtcagcgaggagctgtcgccggcgatgctcggcgaggtgccggaagggcgcctggtcggcctggtctcggtgctcggctcgggcaactcgcacgtggcgatcctcgcccgtgccatgggcatccccacggtgatgggggcggtcgacctgccgtactccaaggtcgacggtatcgacctgatcgtcgatggctaccacggcgaggtctacaccaacccctccgccgagctggtgcgccagtacagcgacgtggtcgccgaggagcgcgagctgagcaagggcctggcggccctgcgcgagctgccctgcgagaccctcgacggccaccgcatgccgctctgggtcaacaccggcctgctcgccgatgtcgcccgcgcccaggagcgtggcgccgagggcgtgggcctgtaccgcaccgaagtgccgttcatgatcaacgaccgcttccccagcgagaaggaacagctggcgatctaccgcgagcagctcagtgccttccacccgctgccggtgaccatgcgcaccctggatatcggcggcgacaaggcgctgtcctacttcccgatcaaggaagacaacccgttcctcggctggcgcggcatccgcgtcaccctcgaccacccggagatcttcctggtccagacccgcgccatgctcaaggccagcgaaggactggacaacctgcgcatcctgctgccgatgatctccggcacccacgagctggaagaggccctgcacctgatccaccgcgcctggggcgaggtgcgcgacgagggcgtggacatcgccatgccgcctatcggcatgatggtcgagattcccgccgccgtgtaccagacccgcgagctggcccgtcaggtcgacttcctttcggtcggttcgaacgacctgacccagtacctgctggcggtcgaccgcaacaatccgcgggtcgccgacctctacgactacctgcatccggccgtgctgcatgcgttgaagaaggtggtcgacgatgcccacctggaaggcaagccggtgagcatctgcggcgagatggccggcgatcccgcggctgccgtgctgctgatggcgatgggcttcgacagcctgtcgatgaacgccaccaacctgcccaaggtgaagtggctgctgcgccagatcaccctggacaaggcccgggacctgctcggccagttgctcaccttcgacaacccgcaggtcatccacagctcgctgcacctggcgttgcgcaacctcggcctgggtcgcgtgatcaacccggcggctaccgtccagccctgattttccc

SEQ ID NO: 169 - protein, 159 aa, Pseudomonas aeruginosa
MIDSDGFRPNVGIILANEAGQVLWARRINQEAWQFPQGGINDRETPEEALYRELNEEVGLEAGDVRILACTRGWLRYRLPQRLVRTHSQPLCIGQKQKWFLLRLMSDEARVRMDITSKPEFDGWRWVSYWYPLGQVVTFKREVYRRALKELAPRLLARD

SEQ ID NO: 170 - protein, 759 aa, Pseudomonas aeruginosa
MLNTLRKIVQEVNSAKDLKAALGIIVQRVKEAMGTQVCSVYLLDTETQRFVLMATEGLNKRSIGKVSMAPSEGLVGLVGTREEPLNLENAAAHPRYRYFAETGEERYASFLGAPIIHHRRVMGVLVVQQKERRQFDEGEEAFLVTMSAQLAGVIAHAEATGSIRGLGKLGKGIQEAKFVGVPGAPGVGVGKAVVVLPPADLEVVPDKQVDDIDAEIALFKQALEGVRADMRALSSKLASQLRKEERALFDVYLMMLDDASIGNEVKRIIRTGQWAQGALRQVVMEHVQRFELMDDAYLRERASDVKDIGRRLLAYLQEERKQNLTYPEQTIIVSEELSPAMLGEVPEGRLVGLVSVLGSGNSHVAILARAMGIPTVMGAVDLPYSKVDGIDLIVDGYHGEVYTNPSAELVRQYSDVVAEERELSKGLAALRELPCETLDGHRMPLWVNTGLLADVARAQERGAEGVGLYRTEVPFMINDRFPSEKEQLAIYREQLSAFHPLPVTMRTLDIGGDKALSYFPIKEDNPFLGWRGIRVTLDHPEIFLVQTRAMLKASEGLDNLRILLPMISGTHELEEALHLIHRAWGEVRDEGVDIAMPPIGMMVEIPAAVYQTRELARQVDFLSVGSNDLTQYLLAVDRNNPRVADLYDYLHPAVLHALKKVVDDAHLEGKPVSICGEMAGDPAAAVLLMAMGFDSLSMNATNLPKVKWLLRQITLDKARDLLGQLLTFDNPQVIHSSLHLALRNLGLGRVINPAATVQP

SEQ ID NO: 171 - DNA, 1512 bp, Pseudomonas aeruginosa
gtcgatttggaacagcacggtgccggcgcggactgcctggccttcctcgtacaggcgacgggtgacgatgccggcgacgcgcgcccgcgcctcggcctggcggtacgcttccaggcgtccgggcagctcgctggtgatgccgatgggcgccggcctggcgacgatcacgccgacctcggcgggggcctccgcagtcttcccggtgtccgctgcttcttcgcagcccagcaggaatagggcgaccagggccgccagcagcccgcgcagcgagccggtccattggatgtgcatgggtgtccctcgattcgtgaactcgcgagcttgcccgggaaggggcaccgcaactcacgagcggcgcgacagtagcatataatcaatcatgagtgactaattaattggcgtttctgtaacatatccttatgatctgcggcgcctttcccttgtgaggacgttcagtggccaggaaaaccaaagaggaatcccagaaaacccgcgatggcatactcgatgccgccgagcgggttttcctggaaaagggcgtgggcaccactgccatggccgacctggcggacgccgccggggtttctcgcggtgcggtctacggccactacaagaacaagatcgaggtctgtctggcgatgtgcgaccgcgccttcggccagatcgaggtacccgatgaaaacgccagggtgccggcgctggacatcctcctgcgcgccggcatgggctttctccgccagtgctgcgaacccggttcggtgcagcgggtgctggagatcctctacctcaagtgcgaacgcagcgacgagaacgagccgctgttgcgccgccgcgagctgctcgagaagcaggggcaacgcttcggccgacggcagatccgccgggcggtggagcgcggcgaactgccggcgcggctggacgtcgagctggccagcatctatctgcaatcgctgtgggacggcatctgcggcaccctggcctggaccgagcgcttgcgcgacgatccctggagccgcgccgaacgcatgttccgcgccggcctcgatagcctgcgcagttctccctacctcttgctggcggacgcctgagggcgtcaatcgtccgccatcaggtgcctgcgctggtcctcggcgccggcgaccaccagccgctgggcgtcctcctcgctgatgtgcaggcgcttgccatcgatgtagagcaccgacaggcgcgcctcggcgtcggtaccgatgcgcaggctgtcgaccggcgcgcgatgccggctgccttcgatctccacgctgcagatgccttgttccgaatcgatttcgatggacatgggaacctcccgttttctccgcctaccttgggtggaccccgggcatccgcgcgggttctgtcacggtagcttcacgccagcgtcacgcgcctgccaccgcgcttggctgcaatcgtccgcagagaaggcgaggccagcggaggacgacgccatgcggctatgcgtgattggtgcgggctatgtgggactggtga

SEQ ID NO: 172 - protein, 210 aa, Pseudomonas aeruginosa
MARKTKEESQKTRDGILDAAERVFLEKGVGTTAMADLADAAGVSRGAVYGHYKNKIEVCLAMCDRAFGQIEVPDENARVPALDILLRAGMGFLRQCCEPGSVQRVLEILYLKCERSDENEPLLRRRELLEKQGQRFGRRQIRRAVERGELPARLDVELASIYLQSLWDGICGTLAWTERLRDDPWSRAERMFRAGLDSLRSSPYLLLADA

SEQ ID NO: 173 - DNA, 3119 bp, Pseudomonas aeruginosa
cgaggaatccagtcgaggtgcgagtagtccgcactgcgggatctcagcgcgcgaccaccggactcggtgaccaggcgctgggtcggctctgcctcgacggtttcgcctccgctgccggacacgctgctgcccgccgcggcggtgctgaccgaggtcgcggtatgcgccgggcgcggtggcaggttggcattggcgttctgcagcggggagcaatcccagccgccggtggccgataccttgcagtcgaactgatcggcggcctgtacagtcaatgctgcgaccggctgcagagccagcaggctgccggtgaccagcaggggaaactttcttcgaaacacgagggatttcactgccatcttgttaatccgggcttcctgcgcgccatcggcccggtgggccgcacgcctctcgatgggctgaaaaagatgctggataataaagcatgacctgcgcaacggctagggccgtggagaaccccgtaaatgtctgatgatgcccgtttccagcagctgaatcgctggttggactcttgtttgcccgagttgttcgttgccgaaggttggggggaagtgccccccgccgaactgatcccggccagtagcgacgccagcttccgtcgttatttccgctggcagggaggggaccgcagcctggtggtgatggacgcgccgccgccccaggaagactgccgaccgttcgtcaaggtcgccggactgctcgccggagccggcgtgcatgtgccgaggattctcgcccaggatctggagaacggtttcctgctgctcagtgacctgggccggcagacctacctcgacgtgcttcatcccggaaatgccgacgagctgttcgaaccggccctggatgcgctgatcgccttccagaaggtcgatgtcgccggtgtcctgcctgcctacgacgaagcggtgctgcgccgcgagctgcagctgttccccgactggtacctggcccgccacctcggcgtggagctggagggcgagacgctggcccgctggcagcggatctgcgacctgctggtacgcagcgcgctggagcaaccgcgggtgttcgtccatcgcgactatatgccgcgcaacctgatgctcagcgagcccaacccgggcgtcctcgacttccaggacgccctgcacggcccggtcacctacgatgtcacctgcctgtacaaggatgccttcgtcagttggccggagccgcgcgtgcatgccgcgctgagtcgttactggaagaaggcgacctgggccggcatcccgctgccgccaagcttcgaggacttcctccgcgccagcgacctgatgggcgtgcagcgccacctgaaggtgattggcatcttcgcccgtatttgtcaccgcgacggcaagccgcgctacctgggtgacgtgccacgcttcttccgttatctggaaaccgccgtggcgcgccgtcccgagctggccgaactgggcgagctgctggcctcgctgccgcagggagccgaggcatgaaggcgatgatcctcgccgccggccgtggcgagcgcatgcggccgaccaccctgcacacgcccaagccgctgatcgaggccgccggcgtgccattgatcgagcgtcagttgctggcgctgcgccaggccggagtcgacgactgggtgatcaaccatgcctggcttggcgagcagatcgaggcctatctcggcgacggctcgcgcctgggcgggcggatcgcctattcacccgagggagaaccgctggaaaccggcggtggaatcttccgcgccctgccgttgctcggcgagcagccgttcctgttgctcaacggcgatgtctggagcgacttcgactactctcggctgcatcttgccgacggcgacctggcgcatctggtgctggtcgacaacccggcgcaccatcccgccggcgatttccacctggatgccggcggacgggtgggcgagacccgcgaagcgggcggcaacctgacctacagcgggatcgccgtactgcatcccgcgctgttcgagggctgccagccgggcgccttcaagctggcgccgctattgcgcaaggccatcgccgcggggcgggtcagcggcgaacactatcgtgggcagtgggtcgacgtcggtacccacgagcgcctggcggaagtcgagcgattgctggcggagcacgcctgagatgctctggcccgctacgctgatcggagccggagccggctgggccctggccagcatccccggcgccctgctcggcggcctgctggggcaactgctggaccgcaggttgcgcctggagtcctggcgcggcctgctggcgcgcttgcgcgggcgggcggtgaacgatgaggacgacctgctgttccagttgctcggctatctggccaagagcggcgggcgggtggaggagatgcatatccgccaggcgcgcgaggagatggcgttgcgcaagctcgataggcgagcccagcggcgtgccatcgcgtccttcggcaagggcaaggccggcatcgcccatctgcaggcggaggtcgcgcgtctgaagggcgaacgtgcggaggcagtattgctcgcctgctggcggatggcctgggctggcggcgtgctcagccagtcggcgcgacaactggtgttgcaatgggggcgctggctgggttggtcggcggagcgaacggaacgcttgtcggcgcgggtcatgccgaagcggacgcgcgctgtcgcccgggatagctaccgtgaggccctgctgctgctcggcgtggaggccggaagcgagccggcgctgatcaaacgcgcctatcgcaagctgatcagccagcatcatccggacaaactggcgggagccggcgccagcgtcgagcgcgtgcgtgcggctaccgagaaaacccgtgaattgcaggcggcctacgccctggtccgagagcgtgaggggttccgctgatcactccgcaggtttctgcgcatcggcctgcaggtgaagactgagccagccgcggattcgtcggtacagttgctcctgctccgccttggggtcggccggtagagcctgcatcgcgatttgtacgtaggccgggtgtttctgccgcttgccggcctgcatgcgcagcctggccgcctcgcggtcggcgcg

SEQ ID NO: 174 - protein, 338 aa, Pseudomonas aeruginosa
MSDDARFQQLNRWLDSCLPELFVAEGWGEVPPAELIPASSDASFRRYFRWQGGDRSLVVMDAPPPQEDCRPFVKVAGLLAGAGVHVPRILAQDLENGFLLLSDLGRQTYLDVLHPGNADELFEPALDALIAFQKVDVAGVLPAYDEAVLRRELQLFPDWYLARHLGVELEGETLARWQRICDLLVRSALEQPRVFVHRDYMPRNLMLSEPNPGVLDFQDALHGPVTYDVTCLYKDAFVSWPEPRVHAALSRYWKKATWAGIPLPPSFEDFLRASDLMGVQRHLKVIGIFARICHRDGKPRYLGDVPRFFRYLETAVARRPELAELGELLASLPQGAEA

SEQ ID NO: 175 - protein, 224 aa, Pseudomonas aeruginosa
MKAMILAAGRGERMRPTTLHTPKPLIEAAGVPLIERQLLALRQAGVDDWVINHAWLGEQIEAYLGDGSRLGGRIAYSPEGEPLETGGGIFRALPLLGEQPFLLLNGDVWSDFDYSRLHLADGDLAHLVLVDNPAHHPAGDFHLDAGGRVGETREAGGNLTYSGIAVLHPALFEGCQPGAFKLAPLLRKAIAAGRVSGEHYRGQWVDVGTHERLAEVERLLAEHA

SEQ ID NO: 176 - protein, 252 aa, Pseudomonas aeruginosa
MLWPATLIGAGAGWALASIPGALLGGLLGQLLDRRLRLESWRGLLARLRGRAVNDEDDLLFQLLGYLAKSGGRVEEMHIRQAREEMALRKLDRRAQRRAIASFGKGKAGIAHLQAEVARLKGERAEAVLLACWRMAWAGGVLSQSARQLVLQWGRWLGWSAERTERLSARVMPKRTRAVARDSYREALLLLGVEAGSEPALIKRAYRKLISQHHPDKLAGAGASVERVRAATEKTRELQAAYALVREREGFR

SEQ ID NO: 177 - DNA, 24 bp, Pseudomonas aeruginosa
gcactgatcgctgcgtagcacggc

SEQ ID NO: 178 - DNA, 24 bp, Pseudomonas aeruginosa
tgacgtagccggaacgcaggctgc

SEQ ID NO: 179 - DNA, 20 bp, Pseudomonas aeruginosa
cgaggaatccagtcgaggtg

SEQ ID NO: 180 - DNA, 21 bp, Pseudomonas aeruginosa
gcaagatgcagccgagagtag

SEQ ID NO: 181 - DNA, 30 bp, Pseudomonas aeruginosa
gtcagaattctcagcttgacgttgttgccc

SEQ ID NO: 182 - DNA, 31 bp, Pseudomonas aeruginosa
gtcagaattcgacttctattaccgcgacgcc

SEQ ID NO: 183 - DNA, 31 bp, Pseudomonas aeruginosa
gtcagaattcgatgttccagtcccagatccc

SEQ ID NO: 184 - DNA, 30 bp, Pseudomonas aeruginosa
gtcagaattccagtagaccaccgccgagag

SEQ ID NO: 185 - DNA, 24 bp, Pseudomonas aeruginosa
ggtctagacgaactgagcgaggag

SEQ ID NO: 186 - DNA, 20 bp, Pseudomonas aeruginosa
gcctgcaggcgttctacctg

SEQ ID NO: 187 - DNA, 36 bp, Pseudomonas aeruginosa
ggctgcagtgattgactgagcgtctgctggagaacg

SEQ ID NO: 188 - DNA, 35 bp, Pseudomonas aeruginosa
gggaagcttcgtctagaatcacgtgaacatgttcc

SEQ ID NO: 189 - DNA, 1932 bp, Pseudomonas aeruginosa
atggagcctcccatgtttcaactcctttcctggatatccaggaagccgtcccccaccccaacaaccaaagctgccccagggggattcatccttcctctgagcagcatggaactgctcggcacgcctcgccgccggcagctactggagaacatctggcagcgcgcctcgctatccaagcagcaattcgaggagatctaccggcggccactggccaactatgccgagctggtccagcagctccctgcttcggaaaatcatcaccatgcccatccaggcgggatgatcgatcacggcctggagatcgtggcctacgcactcaaggtacggcagacctacctgctcccgatcggcgcagcgccggagtcacagtcagcccaggctgaagcctggtcggccgccgcggcgtatggcgccctggctcatgacataggcaagatcgtcgtcgacctgcaggttgagctacaggacggcagcacctggcacccttggaacggaccgatcaaccagccataccgcttcaagtacgtgaagtcccgcgaataccagctccacggcgctgcctcagcacttctcatccaccaactgctaccgcgcactgcactcgattggctcagtcgctttccagagctgtgggctcaattgatctacctgttcgctgggcagtacgagcacgccgggatcctcggcgagatcatcgtgaaggcagaccaggcctcagttgcacaggagctaggaggcaatccggatcgagctctggctgcaccgaagcagtcgctgcagcggcagttggcagacggccttcgcttcttggtgaaggacaagttcaagttgaatcaacctagcggcccgtctgatggatggctgacccaggacgcactctggctggtgagcaagcctgctgccgatcaactgagagcctacctgctggcccagggtatcgatggggtgccctcctctaacgcgccgttcttcagcatgctccaggaccaagccgtcatccagacaaatgccgaggacaaggccatttggacggccacggtagacaacggtgctggatggagaaacaagttcacgctactcaagattgctccagccttgatctggacagatgctgccgagcgcccctcaccctacagcggatcactggtcgttgaagatggaaccgcctcaacggaaaagccggaaacgacctgtgaaattcccaacgggccggctgaacagcagcaagcaccagaaacgaagatgatgctccatcaacctgcgccgagcgttgcgaaaccggcaaacgagacgcaggcgattgcgaaaccctcaactgatgatcaagaagaaacagacgatttgtatgcacttcttggtaatatcaattcgccactagaagagctagacactagccacgactcgccggctgcctctcctacgaacacacgcggggaggagaacctacagcagccactagggaccaaggagccaacagattgcgctcctgaagcaattgaagatgtatttatgcctagcagaagtactgatctgggacagggattcgttggttggatgaaatctggcatcgcggcccgtcgcctgttcatcaacgacaccaaggctttggtgcataccgtagacgggaccgccatgctggtcacgccaggaattttcaagcgctatgtccaagagcatccggtgcttgaaaaactggcccaagccaaggagacgaccggctggaagctggtgcagcgcgcgttcgaaaaacaggggcttcatcggaagaccagtaaaaacctgaacatctggaccatcaaggtttctggtcctcgcaagacgaaagagctcaaggcctacctgctccaggatcccaaattgctgttccctgagcagcctctggacaacccaagcctcacggtcatcaccgatgccgaaggaggtgtggaatga

SEQ ID NO: 190 - DNA, 1920 bp, Pseudomonas aeruginosa
atgtttcaactcctttcctggatatccaggaagccgtcccccaccccaacaaccaaagctgccccagggggattcatccttcctctgagcagcatggaactgctcggcacgcctcgccgccggcagctactggagaacatctggcagcgcgcctcgctatccaagcagcaattcgaggagatctaccggcggccactggccaactatgccgagctggtccagcagctccctgcttcggaaaatcatcaccatgcccatccaggcgggatgatcgatcacggcctggagatcgtggcctacgcactcaaggtacggcagacctacctgctcccgatcggcgcagcgccggagtcacagtcagcccaggctgaagcctggtcggccgccgcggcgtatggcgccctggctcatgacataggcaagatcgtcgtcgacctgcaggttgagctacaggacggcagcacctggcacccttggaacggaccgatcaaccagccataccgcttcaagtacgtgaagtcccgcgaataccagctccacggcgctgcctcagcacttctcatccaccaactgctaccgcgcactgcactcgattggctcagtcgctttccagagctgtgggctcaattgatctacctgttcgctgggcagtacgagcacgccgggatcctcggcgagatcatcgtgaaggcagaccaggcctcagttgcacaggagctaggaggcaatccggatcgagctctggctgcaccgaagcagtcgctgcagcggcagttggcagacggccttcgcttcttggtgaaggacaagttcaagttgaatcaacctagcggcccgtctgatggatggctgacccaggacgcactctggctggtgagcaagcctgctgccgatcaactgagagcctacctgctggcccagggtatcgatggggtgccctcctctaacgcgccgttcttcagcatgctccaggaccaagccgtcatccagacaaatgccgaggacaaggccatttggacggccacggtagacaacggtgctggatggagaaacaagttcacgctactcaagattgctccagccttgatctggacagatgctgccgagcgcccctcaccctacagcggatcactggtcgttgaagatggaaccgcctcaacggaaaagccggaaacgacctgtgaaattcccaacgggccggctgaacagcagcaagcaccagaaacgaagatgatgctccatcaacctgcgccgagcgttgcgaaaccggcaaacgagacgcaggcgattgcgaaaccctcaactgatgatcaagaagaaacagacgatttgtatgcacttcttggtaatatcaattcgccactagaagagctagacactagccacgactcgccggctgcctctcctacgaacacacgcggggaggagaacctacagcagccactagggaccaaggagccaacagattgcgctcctgaagcaattgaagatgtatttatgcctagcagaagtactgatctgggacagggattcgttggttggatgaaatctggcatcgcggcccgtcgcctgttcatcaacgacaccaaggctttggtgcataccgtagacgggaccgccatgctggtcacgccaggaattttcaagcgctatgtccaagagcatccggtgcttgaaaaactggcccaagccaaggagacgaccggctggaagctggtgcagcgcgcgttcgaaaaacaggggcttcatcggaagaccagtaaaaacctgaacatctggaccatcaaggtttctggtcctcgcaagacgaaagagctcaaggcctacctgctccaggatcccaaattgctgttccctgagcagcctctggacaacccaagcctcacggtcatcaccgatgccgaaggaggtgtggaatga

SEQ ID NO: 191 - DNA, 1827 bp, Pseudomonas aeruginosa
atggaactgctcggcacgcctcgccgccggcagctactggagaacatctggcagcgcgcctcgctatccaagcagcaattcgaggagatctaccggcggccactggccaactatgccgagctggtccagcagctccctgcttcggaaaatcatcaccatgcccatccaggcgggatgatcgatcacggcctggagatcgtggcctacgcactcaaggtacggcagacctacctgctcccgatcggcgcagcgccggagtcacagtcagcccaggctgaagcctggtcggccgccgcggcgtatggcgccctggctcatgacataggcaagatcgtcgtcgacctgcaggttgagctacaggacggcagcacctggcacccttggaacggaccgatcaaccagccataccgcttcaagtacgtgaagtcccgcgaataccagctccacggcgctgcctcagcacttctcatccaccaactgctaccgcgcactgcactcgattggctcagtcgctttccagagctgtgggctcaattgatctacctgttcgctgggcagtacgagcacgccgggatcctcggcgagatcatcgtgaaggcagaccaggcctcagttgcacaggagctaggaggcaatccggatcgagctctggctgcaccgaagcagtcgctgcagcggcagttggcagacggccttcgcttcttggtgaaggacaagttcaagttgaatcaacctagcggcccgtctgatggatggctgacccaggacgcactctggctggtgagcaagcctgctgccgatcaactgagagcctacctgctggcccagggtatcgatggggtgccctcctctaacgcgccgttcttcagcatgctccaggaccaagccgtcatccagacaaatgccgaggacaaggccatttggacggccacggtagacaacggtgctggatggagaaacaagttcacgctactcaagattgctccagccttgatctggacagatgctgccgagcgcccctcaccctacagcggatcactggtcgttgaagatggaaccgcctcaacggaaaagccggaaacgacctgtgaaattcccaacgggccggctgaacagcagcaagcaccagaaacgaagatgatgctccatcaacctgcgccgagcgttgcgaaaccggcaaacgagacgcaggcgattgcgaaaccctcaactgatgatcaagaagaaacagacgatttgtatgcacttcttggtaatatcaattcgccactagaagagctagacactagccacgactcgccggctgcctctcctacgaacacacgcggggaggagaacctacagcagccactagggaccaaggagccaacagattgcgctcctgaagcaattgaagatgtatttatgcctagcagaagtactgatctgggacagggattcgttggttggatgaaatctggcatcgcggcccgtcgcctgttcatcaacgacaccaaggctttggtgcataccgtagacgggaccgccatgctggtcacgccaggaattttcaagcgctatgtccaagagcatccggtgcttgaaaaactggcccaagccaaggagacgaccggctggaagctggtgcagcgcgcgttcgaaaaacaggggcttcatcggaagaccagtaaaaacctgaacatctggaccatcaaggtttctggtcctcgcaagacgaaagagctcaaggcctacctgctccaggatcccaaattgctgttccctgagcagcctctggacaacccaagcctcacggtcatcaccgatgccgaaggaggtgtggaatga

SEQ ID NO: 192 - DNA, 1653 bp, Pseudomonas aeruginosa
atgatcgatcacggcctggagatcgtggcctacgcactcaaggtacggcagacctacctgctcccgatcggcgcagcgccggagtcacagtcagcccaggctgaagcctggtcggccgccgcggcgtatggcgccctggctcatgacataggcaagatcgtcgtcgacctgcaggttgagctacaggacggcagcacctggcacccttggaacggaccgatcaaccagccataccgcttcaagtacgtgaagtcccgcgaataccagctccacggcgctgcctcagcacttctcatccaccaactgctaccgcgcactgcactcgattggctcagtcgctttccagagctgtgggctcaattgatctacctgttcgctgggcagtacgagcacgccgggatcctcggcgagatcatcgtgaaggcagaccaggcctcagttgcacaggagctaggaggcaatccggatcgagctctggctgcaccgaagcagtcgctgcagcggcagttggcagacggccttcgcttcttggtgaaggacaagttcaagttgaatcaacctagcggcccgtctgatggatggctgacccaggacgcactctggctggtgagcaagcctgctgccgatcaactgagagcctacctgctggcccagggtatcgatggggtgccctcctctaacgcgccgttcttcagcatgctccaggaccaagccgtcatccagacaaatgccgaggacaaggccatttggacggccacggtagacaacggtgctggatggagaaacaagttcacgctactcaagattgctccagccttgatctggacagatgctgccgagcgcccctcaccctacagcggatcactggtcgttgaagatggaaccgcctcaacggaaaagccggaaacgacctgtgaaattcccaacgggccggctgaacagcagcaagcaccagaaacgaagatgatgctccatcaacctgcgccgagcgttgcgaaaccggcaaacgagacgcaggcgattgcgaaaccctcaactgatgatcaagaagaaacagacgatttgtatgcacttcttggtaatatcaattcgccactagaagagctagacactagccacgactcgccggctgcctctcctacgaacacacgcggggaggagaacctacagcagccactagggaccaaggagccaacagattgcgctcctgaagcaattgaagatgtatttatgcctagcagaagtactgatctgggacagggattcgttggttggatgaaatctggcatcgcggcccgtcgcctgttcatcaacgacaccaaggctttggtgcataccgtagacgggaccgccatgctggtcacgccaggaattttcaagcgctatgtccaagagcatccggtgcttgaaaaactggcccaagccaaggagacgaccggctggaagctggtgcagcgcgcgttcgaaaaacaggggcttcatcggaagaccagtaaaaacctgaacatctggaccatcaaggtttctggtcctcgcaagacgaaagagctcaaggcctacctgctccaggatcccaaattgctgttccctgagcagcctctggacaacccaagcctcacggtcatcaccgatgccgaaggaggtgtggaatga

SEQ ID NO: 193 - DNA, 957 bp, Pseudomonas aeruginosa
atgctccaggaccaagccgtcatccagacaaatgccgaggacaaggccatttggacggccacggtagacaacggtgctggatggagaaacaagttcacgctactcaagattgctccagccttgatctggacagatgctgccgagcgcccctcaccctacagcggatcactggtcgttgaagatggaaccgcctcaacggaaaagccggaaacgacctgtgaaattcccaacgggccggctgaacagcagcaagcaccagaaacgaagatgatgctccatcaacctgcgccgagcgttgcgaaaccggcaaacgagacgcaggcgattgcgaaaccctcaactgatgatcaagaagaaacagacgatttgtatgcacttcttggtaatatcaattcgccactagaagagctagacactagccacgactcgccggctgcctctcctacgaacacacgcggggaggagaacctacagcagccactagggaccaaggagccaacagattgcgctcctgaagcaattgaagatgtatttatgcctagcagaagtactgatctgggacagggattcgttggttggatgaaatctggcatcgcggcccgtcgcctgttcatcaacgacaccaaggctttggtgcataccgtagacgggaccgccatgctggtcacgccaggaattttcaagcgctatgtccaagagcatccggtgcttgaaaaactggcccaagccaaggagacgaccggctggaagctggtgcagcgcgcgttcgaaaaacaggggcttcatcggaagaccagtaaaaacctgaacatctggaccatcaaggtttctggtcctcgcaagacgaaagagctcaaggcctacctgctccaggatcccaaattgctgttccctgagcagcctctggacaacccaagcctcacggtcatcaccgatgccgaaggaggtgtggaatga

SEQ ID NO: 194 - DNA, 690 bp, Pseudomonas aeruginosa
atgatgctccatcaacctgcgccgagcgttgcgaaaccggcaaacgagacgcaggcgattgcgaaaccctcaactgatgatcaagaagaaacagacgatttgtatgcacttcttggtaatatcaattcgccactagaagagctagacactagccacgactcgccggctgcctctcctacgaacacacgcggggaggagaacctacagcagccactagggaccaaggagccaacagattgcgctcctgaagcaattgaagatgtatttatgcctagcagaagtactgatctgggacagggattcgttggttggatgaaatctggcatcgcggcccgtcgcctgttcatcaacgacaccaaggctttggtgcataccgtagacgggaccgccatgctggtcacgccaggaattttcaagcgctatgtccaagagcatccggtgcttgaaaaactggcccaagccaaggagacgaccggctggaagctggtgcagcgcgcgttcgaaaaacaggggcttcatcggaagaccagtaaaaacctgaacatctggaccatcaaggtttctggtcctcgcaagacgaaagagctcaaggcctacctgctccaggatcccaaattgctgttccctgagcagcctctggacaacccaagcctcacggtcatcaccgatgccgaaggaggtgtggaatga

SEQ ID NO: 195 - DNA, 687 bp, Pseudomonas aeruginosa
atgctccatcaacctgcgccgagcgttgcgaaaccggcaaacgagacgcaggcgattgcgaaaccctcaactgatgatcaagaagaaacagacgatttgtatgcacttcttggtaatatcaattcgccactagaagagctagacactagccacgactcgccggctgcctctcctacgaacacacgcggggaggagaacctacagcagccactagggaccaaggagccaacagattgcgctcctgaagcaattgaagatgtatttatgcctagcagaagtactgatctgggacagggattcgttggttggatgaaatctggcatcgcggcccgtcgcctgttcatcaacgacaccaaggctttggtgcataccgtagacgggaccgccatgctggtcacgccaggaattttcaagcgctatgtccaagagcatccggtgcttgaaaaactggcccaagccaaggagacgaccggctggaagctggtgcagcgcgcgttcgaaaaacaggggcttcatcggaagaccagtaaaaacctgaacatctggaccatcaaggtttctggtcctcgcaagacgaaagagctcaaggcctacctgctccaggatcccaaattgctgttccctgagcagcctctggacaacccaagcctcacggtcatcaccgatgccgaaggaggtgtggaatga

SEQ ID NO: 196 - DNA, 423 bp, Pseudomonas aeruginosa
atgcctagcagaagtactgatctgggacagggattcgttggttggatgaaatctggcatcgcggcccgtcgcctgttcatcaacgacaccaaggctttggtgcataccgtagacgggaccgccatgctggtcacgccaggaattttcaagcgctatgtccaagagcatccggtgcttgaaaaactggcccaagccaaggagacgaccggctggaagctggtgcagcgcgcgttcgaaaaacaggggcttcatcggaagaccagtaaaaacctgaacatctggaccatcaaggtttctggtcctcgcaagacgaaagagctcaaggcctacctgctccaggatcccaaattgctgttccctgagcagcctctggacaacccaagcctcacggtcatcaccgatgccgaaggaggtgtggaatga

SEQ ID NO: 197 - DNA, 378 bp, Pseudomonas aeruginosa
atgaaatctggcatcgcggcccgtcgcctgttcatcaacgacaccaaggctttggtgcataccgtagacgggaccgccatgctggtcacgccaggaattttcaagcgctatgtccaagagcatccggtgcttgaaaaactggcccaagccaaggagacgaccggctggaagctggtgcagcgcgcgttcgaaaaacaggggcttcatcggaagaccagtaaaaacctgaacatctggaccatcaaggtttctggtcctcgcaagacgaaagagctcaaggcctacctgctccaggatcccaaattgctgttccctgagcagcctctggacaacccaagcctcacggtcatcaccgatgccgaaggaggtgtggaatga

SEQ ID NO: 198 - DNA, 300 bp, Pseudomonas aeruginosa
atgctggtcacgccaggaattttcaagcgctatgtccaagagcatccggtgcttgaaaaactggcccaagccaaggagacgaccggctggaagctggtgcagcgcgcgttcgaaaaacaggggcttcatcggaagaccagtaaaaacctgaacatctggaccatcaaggtttctggtcctcgcaagacgaaagagctcaaggcctacctgctccaggatcccaaattgctgttccctgagcagcctctggacaacccaagcctcacggtcatcaccgatgccgaaggaggtgtggaatga

SEQ ID NO: 199 - protein, 643 aa, Pseudomonas aeruginosa
MEPPMFQLLSWISRKPSPTPTTKAAPGGFILPLSSMELLGTPRRRQLLENIWQRASLSKQQFEEIYRRPLANYAELVQQLPASENHHHAHPGGMIDHGLEIVAYALKVRQTYLLPIGAAPESQSAQAEAWSAAAAYGALAHDIGKIVVDLQVELQDGSTWHPWNGPINQPYRFKYVKSREYQLHGAASALLIHQLLPRTALDWLSRFPELWAQLIYLFAGQYEHAGILGEIIVKADQASVAQELGGNPDRALAAPKQSLQRQLADGLRFLVKDKFKLNQPSGPSDGWLTQDALWLVSKPAADQLRAYLLAQGIDGVPSSNAPFFSMLQDQAVIQTNAEDKAIWTATVDNGAGWRNKFTLLKIAPALIWTDAAERPSPYSGSLVVEDGTASTEKPETTCEIPNGPAEQQQAPETKMMLHQPAPSVAKPANETQAIAKPSTDDQEETDDLYALLGNINSPLEELDTSHDSPAASPTNTRGEENLQQPLGTKEPTDCAPEAIEDVFMPSRSTDLGQGFVGWMKSGIAARRLFINDTKALVHTVDGTAMLVTPGIFKRYVQEHPVLEKLAQAKETTGWKLVQRAFEKQGLHRKTSKNLNIWTIKVSGPRKTKELKAYLLQDPKLLFPEQPLDNPSLTVITDAEGGVE

SEQ ID NO: 200 - protein, 639 aa, Pseudomonas aeruginosa
MFQLLSWISRKPSPTPTTKAAPGGFILPLSSMELLGTPRRRQLLENIWQRASLSKQQFEEIYRRPLANYAELVQQLPASENHHHAHPGGMIDHGLEIVAYALKVRQTYLLPIGAAPESQSAQAEAWSAAAAYGALAHDIGKIVVDLQVELQDGSTWHPWNGPINQPYRFKYVKSREYQLHGAASALLIHQLLPRTALDWLSRFPELWAQLIYLFAGQYEHAGILGEIIVKADQASVAQELGGNPDRALAAPKQSLQRQLADGLRFLVKDKFKLNQPSGPSDGWLTQDALWLVSKPAADQLRAYLLAQGIDGVPSSNAPFFSMLQDQAVIQTNAEDKAIWTATVDNGAGWRNKFTLLKIAPALIWTDAAERPSPYSGSLVVEDGTASTEKPETTCEIPNGPAEQQQAPETKMMLHQPAPSVAKPANETQAIAKPSTDDQEETDDLYALLGNINSPLEELDTSHDSPAASPTNTRGEENLQQPLGTKEPTDCAPEAIEDVFMPSRSTDLGQGFVGWMKSGIAARRLFINDTKALVHTVDGTAMLVTPGIFKRYVQEHPVLEKLAQAKETTGWKLVQRAFEKQGLHRKTSKNLNIWTIKVSGPRKTKELKAYLLQDPKLLFPEQPLDNPSLTVITDAEGGVE

SEQ ID NO: 201 - protein, 608 aa, Pseudomonas aeruginosa
MELLGTPRRRQLLENIWQRASLSKQQFEEIYRRPLANYAELVQQLPASENHHHAHPGGMIDHGLEIVAYALKVRQTYLLPIGAAPESQSAQAEAWSAAAAYGALAHDIGKIVVDLQVELQDGSTWHPWNGPINQPYRFKYVKSREYQLHGAASALLIHQLLPRTALDWLSRFPELWAQLIYLFAGQYEHAGILGEIIVKADQASVAQELGGNPDRALAAPKQSLQRQLADGLRFLVKDKFKLNQPSGPSDGWLTQDALWLVSKPAADQLRAYLLAQGIDGVPSSNAPFFSMLQDQAVIQTNAEDKAIWTATVDNGAGWRNKFTLLKIAPALIWTDAAERPSPYSGSLVVEDGTASTEKPETTCEIPNGPAEQQQAPETKMMLHQPAPSVAKPANETQAIAKPSTDDQEETDDLYALLGNINSPLEELDTSHDSPAASPTNTRGEENLQQPLGTKEPTDCAPEAIEDVFMPSRSTDLGQGFVGWMKSGIAARRLFINDTKALVHTVDGTAMLVTPGIFKRYVQEHPVLEKLAQAKETTGWKLVQRAFEKQGLHRKTSKNLNIWTIKVSGPRKTKELKAYLLQDPKLLFPEQPLDNPSLTVITDAEGGVE

SEQ ID NO: 202 - protein, 550 aa, Pseudomonas aeruginosa
MIDHGLEIVAYALKVRQTYLLPIGAAPESQSAQAEAWSAAAAYGALAHDIGKIVVDLQVELQDGSTWHPWNGPINQPYRFKYVKSREYQLHGAASALLIHQLLPRTALDWLSRFPELWAQLIYLFAGQYEHAGILGEIIVKADQASVAQELGGNPDRALAAPKQSLQRQLADGLRFLVKDKFKLNQPSGPSDGWLTQDALWLVSKPAADQLRAYLLAQGIDGVPSSNAPFFSMLQDQAVIQTNAEDKAIWTATVDNGAGWRNKFTLLKIAPALIWTDAAERPSPYSGSLVVEDGTASTEKPETTCEIPNGPAEQQQAPETKMMLHQPAPSVAKPANETQAIAKPSTDDQEETDDLYALLGNINSPLEELDTSHDSPAASPTNTRGEENLQQPLGTKEPTDCAPEAIEDVFMPSRSTDLGQGFVGWMKSGIAARRLFINDTKALVHTVDGTAMLVTPGIFKRYVQEHPVLEKLAQAKETTGWKLVQRAFEKQGLHRKTSKNLNIWTIKVSGPRKTKELKAYLLQDPKLLFPEQPLDNPSLTVITDAEGGVE

SEQ ID NO: 203 - protein, 318 aa, Pseudomonas aeruginosa
MLQDQAVIQTNAEDKAIWTATVDNGAGWRNKFTLLKIAPALIWTDAAERPSPYSGSLVVEDGTASTEKPETTCEIPNGPAEQQQAPETKMMLHQPAPSVAKPANETQAIAKPSTDDQEETDDLYALLGNINSPLEELDTSHDSPAASPTNTRGEENLQQPLGTKEPTDCAPEAIEDVFMPSRSTDLGQGFVGWMKSGIAARRLFINDTKALVHTVDGTAMLVTPGIFKRYVQEHPVLEKLAQAKETTGWKLVQRAFEKQGLHRKTSKNLNIWTIKVSGPRKTKELKAYLLQDPKLLFPEQPLDNPSLTVITDAEGGVE

SEQ ID NO: 204 - protein, 229 aa, Pseudomonas aeruginosa
MMLHQPAPSVAKPANETQAIAKPSTDDQEETDDLYALLGNINSPLEELDTSHDSPAASPTNTRGEENLQQPLGTKEPTDCAPEAIEDVFMPSRSTDLGQGFVGWMKSGIAARRLFINDTKALVHTVDGTAMLVTPGIFKRYVQEHPVLEKLAQAKETTGWKLVQRAFEKQGLHRKTSKNLNIWTIKVSGPRKTKELKAYLLQDPKLLFPEQPLDNPSLTVITDAEGGVE

SEQ ID NO: 205 - protein, 228 aa, Pseudomonas aeruginosa
MLHQPAPSVAKPANETQAIAKPSTDDQEETDDLYALLGNINSPLEELDTSHDSPAASPTNTRGEENLQQPLGTKEPTDCAPEAIEDVFMPSRSTDLGQGFVGWMKSGIAARRLFINDTKALVHTVDGTAMLVTPGIFKRYVQEHPVLEKLAQAKETTGWKLVQRAFEKQGLHRKTSKNLNIWTIKVSGPRKTKELKAYLLQDPKLLFPEQPLDNPSLTVITDAEGGVE

SEQ ID NO: 206 - protein, 140 aa, Pseudomonas aeruginosa
MPSRSTDLGQGFVGWMKSGIAARRLFINDTKALVHTVDGTAMLVTPGIFKRYVQEHPVLEKLAQAKETTGWKLVQRAFEKQGLHRKTSKNLNIWTIKVSGPRKTKELKAYLLQDPKLLFPEQPLDNPSLTVITDAEGGVE

SEQ ID NO: 207 - protein, 125 aa, Pseudomonas aeruginosa
MKSGIAARRLFINDTKALVHTVDGTAMLVTPGIFKRYVQEHPVLEKLAQAKETTGWKLVQRAFEKQGLHRKTSKNLNIWTIKVSGPRKTKELKAYLLQDPKLLFPEQPLDNPSLTVITDAEGGVE

SEQ ID NO: 208 - protein, 99 aa, Pseudomonas aeruginosa
MLVTPGIFKRYVQEHPVLEKLAQAKETTGWKLVQRAFEKQGLHRKTSKNLNIWTIKVSGPRKTKELKAYLLQDPKLLFPEQPLDNPSLTVITDAEGGVE

SEQ ID NO: 209 - protein, 252 aa, Pseudomonas aeruginosa
MRRDAPSDAGFHQTQHVVEVFHEEHLVADRPQQVRMLPGAAAEADLPVIGQARDAVQGGIAQRVLRMGDDERLGVAEHALVEAGDLQFLVDGDGDIDFRVVLLDRRQAIGGRGAYQADHVEIVEQYAAHRIAERRRDGGVQQHPEIARTLVEIEGDVADQLLVVQQAAHVRDQAKRLLGGFDLVAVPTDQLHAQVDFQVADRRADRGVRLAQDPRSGGNRTGGDDLEEHVHVIQVMNRHPLFLLLGGACRFP

SEQ ID NO: 210 - DNA, 624 bp, Pseudomonas aeruginosa
gctacccgaaccccagcgctggaatcctcagccagcgacagcgtcttttgctccgccgtgacttcccagagctctgccatcgaccgcttcttcgggatccagctgatgagggtttggttggacgtgacggcaccttccacgtgtgcatggcaggtgctgccacgcttcttggacttcttcttgccactcggttctgcttcgtcgtcgtcttcaagctcgaagggcttcaggtcgtcgtcctcgtcctcgtcatctccgtcaacggcgccctcagcgcctgcgccttgcgcggcggccttctcggcgtccgtcttgaccgtcacgctgtccagatccgtgatgaccagtgttgtgagcccaacgaaggcgatcagctcctggaaccgatgcgcgaacgcaccaccgacttcaaggatggttagggcggaagaacgcaggcgcttggccaccaactcgatcattgcaggcaggagcagacgctcgacgttgccttccaccaatatcaccgcgtcggaaaaaaagagatcgcagtgcgtcagcttcagataccgctgcaggaattcgcgcgctggagcgtcggacgcgcccgttttgaatagcgacagattgcgcacatccgtgtga

SEQ ID NO: 211 - protein, 207 aa, Pseudomonas aeruginosa
ATRTPALESSASDSVFCSAVTSQSSAIDRFFGIQLMRVWLDVTAPSTCAWQVLPRFLDFFLPLGSASSSSSSSKGFRSSSSSSSSPSTAPSAPAPCAAAFSASVLTVTLSRSVMTSVVSPTKAISSWNRCANAPPTSRMVRAEERRRLATNSIIAGRSRRSTLPSTNITASEKKRSQCVSFRYRCRNSRAGASDAPVLNSDRLRTSV

SEQ ID NO: 212 - DNA, 462 bp, Pseudomonas aeruginosa
tgtcgtcgcacccaccgtcaccgaaaccttggtctggtaagctacccgaaccccagcgctggaatcctcagccagcgacagcgtcttttgctccgccgtgacttcccagagctctgccatcgaccgcttcttcgggatccagctgatgagggtttggttggacgtgacggcaccttccacgtgtgcatggcaggtgctgccacgcttcttggacttcttcttgccactcggttctgcttcgtcgtcgtcttcaagctcgaagggcttcaggtcgtcgtcctcgtcctcgtcatctccgtcaacggcgccctcagcgcctgcgccttgcgcggcggccttctcggcgtccgtcttgaccgtcacgctgtccagatccgtgatgaccagtgttgtgagcccaacgaaggcgatcagctcctggaaccgatgcgcgaacgcaccaccgacttcaaggatggttag

SEQ ID NO: 213 - protein, 153 aa, Pseudomonas aeruginosa
CRRTHRHRNLGLVSYPNPSAGILSQRQRLLLRRDFPELCHRPLLRDPADEGLVGRDGTFHVCMAGAATLLGLLLATRFCFVVVFKLEGLQVVVLVLVISVNGALSACALRGGLLGVRLDRHAVQIRDDQCCEPNEGDQLLEPMRERTTDFKDG

SEQ ID NO: 214 - DNA, 972 bp, Pseudomonas aeruginosa
caggaagtcggcgagctgaaggatgtcctcgtggccaagtatgcccttggcgtagtcactgcccacgccgtagttgaacgtcctgacgccggccacagcctccaggcttcggacatatcgctcttggtcggccttgttcctgtcgcgcgtggtctgccggacacgcgagctgtaattctcgaactcttcttcaagttcggagatccgcctgcggatgtcgttctgcagccaaaccttgatgtcggcctggaacgtctttgcaatagaccagtaaaagctgtggatggtcgagacatgaaccagcgggtcatcgttgacgtccgccaggatttcattggtggcaaggtcggtatacgtgatgcacgcgactatctgcttcctcgcccgcatgctggcgccgtgctccgagatcacccagtccagcgccttgatgagggaggtggtcttgccggaacctgcgccagcacgaaccacgaagggctgcggaggcgtcgctacaatgcatgcgtggatctcgcggtcggcgtcggtatctgggctatcaattcgtctgctcatgccgtctgccccgggtcaacaatgatagcgacaacatcggctgtagtcggctcaatagtcgcgacctcggtggcgatggcagcatccgcctcaagctcgtgggccactttggcttcgagccaggccaagccctcggcgatgtacgcgggaaccttccagccattgagcggcccgcttgcgagtacctccagcgcaaagcgggtcttgtcgaagttcttgccgaccaccctatcgtgtaacttctcagccagctcttcagggctgctcggtgcgcgcttgagcttgaggccgaccgaccggtttgcctcagcctggcaccagtccgcgttctcaagaccaaaggcctcctcaagtgtgcggccgcagagctgtgatgtcgtcgcacccaccgtcaccgaaaccttggtctggtaa

SEQ ID NO: 215 - protein, 323 aa, Pseudomonas aeruginosa
QEVGELKDVLVAKYALGVVTAHAVVERPDAGHSLQASDISLLVGLVPVARGLPDTRAVILELFFKFGDPPADVVLQPNLDVGLERLCNRPVKAVDGRDMNQRVIVDVRQDFIGGKVGIRDARDYLLPRPHAGAVLRDHPVQRLDEGGGLAGTCASTNHEGLRRRRYNACVDLAVGVGIWAINSSAHAVCPGSTMIATTSAVVGSIVATSVAMAASASSSWATLASSQAKPSAMYAGTFQPLSGPLASTSSAKRVLSKFLPTTLSCNFSASSSGLLGARLSLRPTDRFASAWHQSAFSRPKASSSVRPQSCDVVAPTVTETLVW

SEQ ID NO: 216 - DNA, 408 bp, Pseudomonas aeruginosa
cggtgggtgcgacgacatcacagctctgcggccgcacacttgaggaggcctttggtcttgagaacgcggactggtgccaggctgaggcaaaccggtcggtcggcctcaagctcaagcgcgcaccgagcagccctgaagagctggctgagaagttacacgatagggtggtcggcaagaacttcgacaagacccgctttgcgctggaggtactcgcaagcgggccgctcaatggctggaaggttcccgcgtacatcgccgagggcttggcctggctcgaagccaaagtggcccacgagcttgaggcggatgctgccatcgccaccgaggtcgcgactattgagccgactacagccgatgttgtcgctatcattgttgacccggggcagacggcatgagcagacgaattga

SEQ ID NO: 217 - protein, 135 aa, Pseudomonas aeruginosa
RWVRRHHSSAAAHLRRPLVLRTRTGARLRQTGRSASSSSAHRAALKSWLRSYTIGWSARTSTRPALRWRYSQAGRSMAGRFPRTSPRAWPGSKPKWPTSLRRMLPSPPRSRLLSRLQPMLSLSLLTRGRRHEQTN

SEQ ID NO: 218 - DNA, 363 bp, Pseudomonas aeruginosa
gggaggtggtcttgccggaacctgcgccagcacgaaccacgaagggctgcggaggcgtcgctacaatgcatgcgtggatctcgcggtcggcgtcggtatctgggctatcaattcgtctgctcatgccgtctgccccgggtcaacaatgatagcgacaacatcggctgtagtcggctcaatagtcgcgacctcggtggcgatggcagcatccgcctcaagctcgtgggccactttggcttcgagccaggccaagccctcggcgatgtacgcgggaaccttccagccattgagcggcccgcttgcgagtacctccagcgcaaagcgggtcttgtcgaagttcttgccgaccaccctatcgtgtaa

SEQ ID NO: 219 - protein, 120 aa, Pseudomonas aeruginosa
GRWSCRNLRQHEPRRAAEASLQCMRGSRGRRRYLGYQFVCSCRLPRVNNDSDNIGCSRLNSRDLGGDGSIRLKLVGHFGFEPGQALGDVRGNLPAIERPACEYLQRKAGLVEVLADHPIV

SEQ ID NO: 220 - DNA, 1947 bp, Pseudomonas aeruginosa
cccggggcagacggcatgagcagacgaattgatagcccagataccgacgccgaccgcgagatccacgcatgcattgtagcgacgcctccgcagcccttcgtggttcgtgctggcgcaggttccggcaagaccacctccctcatcaaggcgctggactgggtgatctcggagcacggcgccagcatgcgggcgaggaagcagatagtcgcgtgcatcacgtataccgaccttgccaccaatgaaatcctggcggacgtcaacgatgacccgctggttcatgtctcgaccatccacagcttttactggtctattgcaaagacgttccaggccgacatcaaggtttggctgcagaacgacatccgcaggcggatctccgaacttgaagaagagttcgagaattacagctcgcgtgtccggcagaccacgcgcgacaggaacaaggccgaccaagagcgatatgtccgaagcctggaggctgtggccggcgtcaggacgttcaactacggcgtgggcagtgactacgccaagggcatacttggccacgaggacatccttcagctcgccgacttcctgctacaaaaccgcccgctgttccgacgggtcgtggcgctgagctacccgttcgtgtttatcgatgagagtcaggacacgttcccgggtgtagtgaagtctttcaaggaagtggaagcccagatgcagggcaagttctgccttggttttttcggcgacccgatgcagtcgatcttcatgagaggcgcaggggacatccagcttgaggatcattggcgggccatcacgaagccggagaactttcgctgcgccaagcagatccttgacgtcgccaatgccgtgcgcgcgcagggcgatggcatggagcaagtccgcgggctgcacgagagggtcgatgggaacctcaagctggtggaggggtcggcccggatgttcgtcttgccgaacacgctgaaccgaaccgaggctttggcaagagtccgagcgtggagctcggcgacgaacaacgacgagggttggacaaccccagacatcgcagtcaagattcttgtcatcgtgcaccgcatggccgcaaaccggcttggcttcggcggcatctactcggcgctgaacgacaagacgtcggatgccatgaagcaagggatgcaggacggcaccggttggcccgttcgacccttcctaagttttgcgctaccgatcgttgcagctgtgaaggccggcaatgagttcgcggcgatgagcctgctccgggaattcagcccgcgcctggcgcctgcggctctgaccggccgacgtgccgcggatgtattgcgagagctgcacgctgctgcgtcgaggcttgtcgccatgctggacgaggcagggaccaccattggtgacatagctctccatctctgtgacacgggtctttttgagttcgacgagcgctatgcgcgtgttcttgggtttgtcagggatattgctgacaccgctcaggagcccgaggctgctgatgcagttccggccgaaggattatccttggacgcgacaatggccaagttcttcaattgctctgcgcaagagctttggccctatgaacgctatgtctcagaaggctccccctatgccacgcagcacggcgtgaagggagcgcagttcgaacgcgtcatggtggtgatggacgaggaagaaagcgactaccgaacgtacaactacgagcgtgtcttcgcgagtgctgaggcccgcgctgcagatcgtgcacgagcactagacggtgatgaaaacacttggagccgaacgctgcgactgctttacgtctgctgcactcgtgcccagcgggggctggtactagcgttctttgtcgccgaccctgcgaccaccctggaaaacgtcgtggcgagcgggatcttgccgcgaagcgcagtctttacgcaggaagtgttagttggatggccatag

SEQ ID NO: 221 - protein, 648 aa, Pseudomonas aeruginosa
PGADGMSRRIDSPDTDADREIHACIVATPPQPFVVRAGAGSGKTTSLIKALDWVISEHGASMRARKQIVACITYTDLATNEILADVNDDPLVHVSTIHSFYWSIAKTFQADIKVWLQNDIRRRISELEEEFENYSSRVRQTTRDRNKADQERYVRSLEAVAGVRTFNYGVGSDYAKGILGHEDILQLADFLLQNRPLFRRVVALSYPFVFIDESQDTFPGVVKSFKEVEAQMQGKFCLGFFGDPMQSIFMRGAGDIQLEDHWRAITKPENFRCAKQILDVANAVRAQGDGMEQVRGLHERVDGNLKLVEGSARMFVLPNTLNRTEALARVRAWSSATNNDEGWTTPDIAVKILVIVHRMAANRLGFGGIYSALNDKTSDAMKQGMQDGTGWPVRPFLSFALPIVAAVKAGNEFAAMSLLREFSPRLAPAALTGRRAADVLRELHAAASRLVAMLDEAGTTIGDIALHLCDTGLFEFDERYARVLGFVRDIADTAQEPEAADAVPAEGLSLDATMAKFFNCSAQELWPYERYVSEGSPYATQHGVKGAQFERVMVVMDEEESDYRTYNYERVFASAEARAADRARALDGDENTWSRTLRLLYVCCTRAQRGLVLAFFVADPATTLENVVASGILPRSAVFTQEVLVGWP

SEQ ID NO: 222 - DNA, 408 bp, Pseudomonas aeruginosa
tcgcgtgcatcacgtataccgaccttgccaccaatgaaatcctggcggacgtcaacgatgacccgctggttcatgtctcgaccatccacagcttttactggtctattgcaaagacgttccaggccgacatcaaggtttggctgcagaacgacatccgcaggcggatctccgaacttgaagaagagttcgagaattacagctcgcgtgtccggcagaccacgcgcgacaggaacaaggccgaccaagagcgatatgtccgaagcctggaggctgtggccggcgtcaggacgttcaactacggcgtgggcagtgactacgccaagggcatacttggccacgaggacatccttcagctcgccgacttcctgctacaaaaccgcccgctgttccgacgggtcgtggcgctga

SEQ ID NO: 223 - protein, 135 aa, Pseudomonas aeruginosa
SRASRIPTLPPMKSWRTSTMTRWFMSRPSTAFTGLLQRRSRPTSRFGCRTTSAGGSPNLKKSSRITARVSGRPRATGTRPTKSDMSEAWRLWPASGRSTTAWAVTTPRAYLATRTSFSSPTSCYKTARCSDGSWR

SEQ ID NO: 224 - DNA, 615 bp, Pseudomonas aeruginosa
gaagggtcgaacgggccaaccggtgccgtcctgcatcccttgcttcatggcatccgacgtcttgtcgttcagcgccgagtagatgccgccgaagccaagccggtttgcggccatgcggtgcacgatgacaagaatcttgactgcgatgtctggggttgtccaaccctcgtcgttgttcgtcgccgagctccacgctcggactcttgccaaagcctcggttcggttcagcgtgttcggcaagacgaacatccgggccgacccctccaccagcttgaggttcccatcgaccctctcgtgcagcccgcggacttgctccatgccatcgccctgcgcgcgcacggcattggcgacgtcaaggatctgcttggcgcagcgaaagttctccggcttcgtgatggcccgccaatgatcctcaagctggatgtcccctgcgcctctcatgaagatcgactgcatcgggtcgccgaaaaaaccaaggcagaacttgccctgcatctgggcttccacttccttgaaagacttcactacacccgggaacgtgtcctgactctcatcgataaacacgaacgggtagctcagcgccacgacccgtcggaacagcgggcggttttgtag

SEQ ID NO: 225 - protein, 204 aa, Pseudomonas aeruginosa
EGSNGPTGAVLHPLLHGIRRLVVQRRVDAAEAKPVCGHAVHDDKNLDCDVWGCPTLVVVRRRAPRSDSCQSLGSVQRVRQDEHPGRPLHQLEVPIDPLVQPADLLHAIALRAHGIGDVKDLLGAAKVLRLRDGPPMILKLDVPCASHEDRLHRVAEKTKAELALHLGFHFLERLHYTRERVLTLIDKHERVAQRHDPSEQRAVL

SEQ ID NO: 226 - DNA, 327 bp, Pseudomonas aeruginosa
atgccgccgaagccaagccggtttgcggccatgcggtgcacgatgacaagaatcttgactgcgatgtctggggttgtccaaccctcgtcgttgttcgtcgccgagctccacgctcggactcttgccaaagcctcggttcggttcagcgtgttcggcaagacgaacatccgggccgacccctccaccagcttgaggttcccatcgaccctctcgtgcagcccgcggacttgctccatgccatcgccctgcgcgcgcacggcattggcgacgtcaaggatctgcttggcgcagcgaaagttctccggcttcgtgatggcccgccaatga

SEQ ID NO: 227 - protein, 108 aa, Pseudomonas aeruginosa
MPPKPSRFAAMRCTMTRILTAMSGVVQPSSLFVAELHARTLAKASVRFSVFGKTNIRADPSTSLRFPSTLSCSPRTCSMPSPCARTALATSRICLAQRKFSGFVMARQ

SEQ ID NO: 228 - DNA, 399 bp, Pseudomonas aeruginosa
cgtcgccaatgccgtgcgcgcgcagggcgatggcatggagcaagtccgcgggctgcacgagagggtcgatgggaacctcaagctggtggaggggtcggcccggatgttcgtcttgccgaacacgctgaaccgaaccgaggctttggcaagagtccgagcgtggagctcggcgacgaacaacgacgagggttggacaaccccagacatcgcagtcaagattcttgtcatcgtgcaccgcatggccgcaaaccggcttggcttcggcggcatctactcggcgctgaacgacaagacgtcggatgccatgaagcaagggatgcaggacggcaccggttggcccgttcgacccttcctaagttttgcgctaccgatcgttgcagctgtgaaggccggcaatga

SEQ ID NO: 229 - protein, 132 aa, Pseudomonas aeruginosa
RRQCRARAGRWHGASPRAAREGRWEPQAGGGVGPDVRLAEHAEPNRGFGKSPSVELGDEQRRGLDNPRHRSQDSCHRAPHGRKPAWLRRHLLGAERQDVGCHEARDAGRHRLARSTLPKFCATDRCSCEGRQ

SEQ ID NO: 230 - DNA, 330 bp, Pseudomonas aeruginosa
cgctcgtcgaactcaaaaagacccgtgtcacagagatggagagctatgtcaccaatggtggtccctgcctcgtccagcatggcgacaagcctcgacgcagcagcgtgcagctctcgcaatacatccgcggcacgtcggccggtcagagccgcaggcgccaggcgcgggctgaattcccggagcaggctcatcgccgcgaactcattgccggccttcacagctgcaacgatcggtagcgcaaaacttaggaagggtcgaacgggccaaccggtgccgtcctgcatcccttgcttcatggcatccgacgtcttgtcgttcagcgccgagtag

SEQ ID NO: 231 - protein, 109 aa, Pseudomonas aeruginosa
RSSNSKRPVSQRWRAMSPMVVPASSSMATSLDAAACSSRNTSAARRPVRAAGARRGLNSRSRLIAANSLPAFTAATIGSAKLRKGRTGQPVPSCIPCFMASDVLSFSAE

SEQ ID NO: 232 - DNA, 321 bp, Pseudomonas aeruginosa
tccttcggccggaactgcatcagcagcctcgggctcctgagcggtgtcagcaatatccctgacaaacccaagaacacgcgcatagcgctcgtcgaactcaaaaagacccgtgtcacagagatggagagctatgtcaccaatggtggtccctgcctcgtccagcatggcgacaagcctcgacgcagcagcgtgcagctctcgcaatacatccgcggcacgtcggccggtcagagccgcaggcgccaggcgcgggctgaattcccggagcaggctcatcgccgcgaactcattgccggccttcacagctgcaacgatcggtag

SEQ ID NO: 233 - protein, 106 aa, Pseudomonas aeruginosa
SFGRNCISSLGLLSGVSNIPDKPKNTRIALVELKKTRVTEMESYVTNGGPCLVQHGDKPRRSSVQLSQYIRGTSAGQSRRRQARAEFPEQAHRRELIAGLHSCNDR

SEQ ID NO: 234 - DNA, 639 bp, Pseudomonas aeruginosa
atcgactctttgaggaaatgcgtgggaagcctggaaaagtgctgtttcgcctgcaaagaaataattcatgttcatgcgattcgttgtcggcagtgcggcgagtcccaaggctggcgaaggttcatgagctctccaacctcagtagttgcgttggtccttagccttttatcaatcgctgccacaaaacctgtggagcgattgttcgatgcccagcgagcagagctacaaatctccatcacgggtggtgattacaaagctgcccagcttatgttgaccaataacgggtcaaagcctgcaactttagtttccttcgaaatcacatcgaaagccacgaccaatacgaaaacatggtttttggtaagcaatacggatggcgaaattctggagccaggcaaaacttacaaaatcagggcctcaaccgatgagtctatcccaaaaattgtcgaagctgagcgtcggacgattttgaagtctcagtacgcacttgcagataattgcgaattaaccgctaaatacatagaggccacggggcagaaggttgtgcgtgtgcaaccgttcatgtgcgacacacctcctgaaaagggtggcctgccccctggtaaacctggcatacccatttggtaccttggtcaagaatga

SEQ ID NO: 235 - protein, 212 aa, Pseudomonas aeruginosa
IDSLRKCVGSLEKCCFACKEIIHVHAIRCRQCGESQGWRRFMSSPTSVVALVLSLLSIAATKPVERLFDAQRAELQISITGGDYKAAQLMLTNNGSKPATLVSFEITSKATTNTKTWFLVSNTDGEILEPGKTYKIRASTDESIPKIVEAERRTILKSQYALADNCELTAKYIEATGQKVVRVQPFMCDTPPEKGGLPPGKPGIPIWYLGQE

SEQ ID NO: 236 - DNA, 423 bp, Pseudomonas aeruginosa
aggccacggggcagaaggttgtgcgtgtgcaaccgttcatgtgcgacacacctcctgaaaagggtggcctgccccctggtaaacctggcatacccatttggtaccttggtcaagaatgatgtttttatgccgccctgggctttgacgccgattaagcaaagctgtgttcgctcatccaatacgtccctcgcccagttaaacgactgttatgtatatgggtgctgccgctacgtaataccttggccctacgcatacgaagttaattctgaaagcgttcaatggacaatcttcctcctcggcgtcgactgcagcggtaaggtgatctactttcgaaacactgcaagggtaggtccttttttggcagcgtccatataccgaccgtggtatggctcagatgcgctggtactgcatttcaccaaataa

SEQ ID NO: 237 - protein, 140 aa, Pseudomonas aeruginosa
RPRGRRLCVCNRSCATHLLKRVACPLVNLAYPFGTLVKNDVFMPPWALTPIKQSCVRSSNTSLAQLNDCYVYGCCRYVIPWPYAYEVNSESVQWTIFLLGVDCSGKVIYFRNTARVGPFLAASIYRPWYGSDALVLHFTK

SEQ ID NO: 238 - DNA, 546 bp, Pseudomonas aeruginosa
gccaaaatgattgtcattgacaaaaatctagaacatcttgttgcgcaatgcgctatatgtgaaaaaactttatttgacgagttttctctcaagattcaattggggcatacatattacgagccaaaatctttgcccgcctctgcaagcattgtatatgggtcgcatccagccccgtcgacgttttttttggaaccaaaagaaattcagcaaaatttggtgctgaaatccggtgagcaagtcatcacctgcagtaaacatcgatacaaaataccgttagattattttggtctggtgcaaaccaaaggaacccttgcgcgattgttcgtgcaggtaacctgtaatgacggtcaggtagagccggggttcgacgggtacgtaacccttgaaatcgtcaatatgtcgccttggacgatagaaataccggccgtgagcgatatagcacaactttatttggtgaaatgcagtaccagcgcatctgagccataccacggtcggtatatggacgctgccaaaaaaggacctacccttgcagtgtttcgaaagtag

SEQ ID NO: 239 - protein, 181 aa, Pseudomonas aeruginosa
AKMIVIDKNLEHLVAQCAICEKTLFDEFSLKIQLGHTYYEPKSLPASASIVYGSHPAPSTFFLEPKEIQQNLVLKSGEQVITCSKHRYKIPLDYFGLVQTKGTLARLFVQVTCNDGQVEPGFDGYVTLEIVNMSPWTIEIPAVSDIAQLYLVKCSTSASEPYHGRYMDAAKKGPTLAVFRK

SEQ ID NO: 240 - DNA, 765 bp, Pseudomonas aeruginosa
aggacaatggcagggtggccgcgtctcgcagcccaaggacgaaggacaaatctgatgagtgtgttacagatcaaagggcgtacaacgaaatcccacacggattttgacgcggcatcgtactccagcaacagccttatactcactgatgcaggggacgagagaattgaagagttttccctcgaattgtccgtgggtgaagggtggagtgataactattctggcaacgacaaaaacctgtggcgcattgtcgatggtatgacgatcaggggtcacgattctgttgtggtggaggccgctgaagaaatcaaggtgccgcacaatcggtacggcatagtcctacctacgggaagtctttttctctcacgcggcgtgctggttgcttcggcgaaggtcgaacctgcatttgatggcaagctcaagctcaggatattcaacaccaccaacaaaaatgtctgccttaccaaaggcgagaagcttggctctgtgatttttttctccacagaatcgacgcacacccaaagccccatcaagcgtggcagtgaaatatcgacgcttcccatcacgcggcgcgcgcgattgaagaagtggttttcgctcaatcccaccatatgggtcgggtggacgctgaatttaatcggaagttccctggtgtcttctcttataatgtacgccgtctattacaaggttgtgctggaacaccagtcgcagcctcctcagtcacaacaaaacgctcagccatcgccgaacgaagttaagccaaaatga

SEQ ID NO: 241 - protein, 254 aa, Pseudomonas aeruginosa
RTMAGWPRLAAQGRRTNLMSVLQIKGRTTKSHTDFDAASYSSNSLILTDAGDERIEEFSLELSVGEGWSDNYSGNDKNLWRIVDGMTIRGHDSVVVEAAEEIKVPHNRYGIVLPTGSLFLSRGVLVASAKVEPAFDGKLKLRIFNTTNKNVCLTKGEKLGSVIFFSTESTHTQSPIKRGSEISTLPITRRARLKKWFSLNPTIWVGWTLNLIGSSLVSSLIMYAVYYKVVLEHQSQPPQSQQNAQPSPNEVKPK

SEQ ID NO: 242 - DNA, 405 bp, Pseudomonas aeruginosa
acggcgtacattataagagaagacaccagggaacttccgattaaattcagcgtccacccgacccatatggtgggattgagcgaaaaccacttcttcaatcgcgcgcgccgcgtgatgggaagcgtcgatatttcactgccacgcttgatggggctttgggtgtgcgtcgattctgtggagaaaaaaatcacagagccaagcttctcgcctttggtaaggcagacatttttgttggtggtgttgaatatcctgagcttgagcttgccatcaaatgcaggttcgaccttcgccgaagcaaccagcacgccgcgtgagagaaaaagacttcccgtaggtaggactatgccgtaccgattgtgcggcaccttgatttcttcagcggcctccaccacaacagaatcgtga

SEQ ID NO: 243 - protein, 134 aa, Pseudomonas aeruginosa
TAYIIREDTRELPIKFSVHPTHMVGLSENHFFNRARRVMGSVDISLPRLMGLWVCVDSVEKKITEPSFSPLVRQTFLLVVLNILSLSLPSNAGSTFAEATSTPRERKRLPVGRTMPYRLCGTLISSAASTTTES

SEQ ID NO: 244 - DNA, 501 bp, Pseudomonas aeruginosa
tctgtaacacactcatcagatttgtccttcgtccttgggctgcgagacgcggccaccctgccattgtcctttataccggccgatatccccggataccgcctgaaagatgacgtgcgcaaagcgtgcaccaatctgaatttcaaacgcctcgctgtgattgttggtgagcgcgaacgtcatcggccctacataacctggaggcagcacactggaactgaacgttatcccgcttctgaacagcgtgcttctcggaaaaaaaagcgccgccagatcttccggcagatcgaattcttccatggtgctcgccagataagtcttgcccggttccatgacgaagcagtcatccgggtctgcgagcacgacctcgctggcaggggtgcgtcgcgtagattctcgcaagcttccaccccctactgtcaggcgagagaggcctgcgagtctgaggtcaaatccaacgccttccggggtggtcaactcacggtgggcaaggtgcttgattag

SEQ ID NO: 245 - protein, 166 aa, Pseudomonas aeruginosa
SVTHSSDLSFVLGLRDAATLPLSFIPADIPGYRLKDDVRKACTNLNFKRLAVIVGERERHRPYITWRQHTGTERYPASEQRASRKKKRRQIFRQIEFFHGARQISLARFHDEAVIRVCEHDLAGRGASRRFSQASTPYCQAREACESEVKSNAFRGGQLTVGKVLD

SEQ ID NO: 246 - DNA, 534 bp, Pseudomonas aeruginosa
atgatttactcaccgcactcgctcctgaaactggtccgggatggaaaactaatcaagcaccttgcccaccgtgagttgaccaccccggaaggcgttggatttgacctcagactcgcaggcctctctcgcctgacagtagggggtggaagcttgcgagaatctacgcgacgcacccctgccagcgaggtcgtgctcgcagacccggatgactgcttcgtcatggaaccgggcaagacttatctggcgagcaccatggaagaattcgatctgccggaagatctggcggcgcttttttttccgagaagcacgctgttcagaagcgggataacgttcagttccagtgtgctgcctccaggttatgtagggccgatgacgttcgcgctcaccaacaatcacagcgaggcgtttgaaattcagattggtgcacgctttgcgcacgtcatctttcaggcggtatccggggatatcggccggtataaaggacaatggcagggtggccgcgtctcgcagcccaaggacgaaggacaaatctga

SEQ ID NO: 247 - protein, 177 aa, Pseudomonas aeruginosa
MIYSPHSLLKLVRDGKLIKHLAHRELTTPEGVGFDLRLAGLSRLTVGGGSLRESTRRTPASEVVLADPDDCFVMEPGKTYLASTMEEFDLPEDLAALFFPRSTLFRSGITFSSSVLPPGYVGPMTFALTNNHSEAFEIQIGARFAHVIFQAVSGDIGRYKGQWQGGRVSQPKDEGQI

SEQ ID NO: 248 - DNA, 345 bp, Pseudomonas aeruginosa
tggccgttctctgcctgtcgcctctttggcatgactggtcaagtcggatgcaaacggtggtcagcaccaatgcaattgggtggtcatgtgcgatgcaattacgcagttgagcctggcccagttcctcccaagcaaagcataagaccaagatggcacattgccaacaaaatacccttccccgctaccgttgttttatcgttgttgccagccctgatctggcggaaaagcccgctccatgaatcgtcatggagcctcccatgtttcaactcctttcctggatatccaggaagccgtcccccaccccaacaaccaaagctgccccagggggattcatccttcctctga

SEQ ID NO: 249 - protein, 114 aa, Pseudomonas aeruginosa
WPFSACRLFGMTGQVGCKRWSAPMQLGGHVRCNYAVEPGPVPPKQSIRPRWHIANKIPFPATVVLSLLPALIWRKSPLHESSWSLPCFNSFPGYPGSRPPPQQPKLPQGDSSFL

SEQ ID NO: 250 - DNA, 414 bp, Pseudomonas aeruginosa
tctggcggaaaagcccgctccatgaatcgtcatggagcctcccatgtttcaactcctttcctggatatccaggaagccgtcccccaccccaacaaccaaagctgccccagggggattcatccttcctctgagcagcatggaactgctcggcacgcctcgccgccggcagctactggagaacatctggcagcgcgcctcgctatccaagcagcaattcgaggagatctaccggcggccactggccaactatgccgagctggtccagcagctccctgcttcggaaaatcatcaccatgcccatccaggcgggatgatcgatcacggcctggagatcgtggcctacgcactcaaggtacggcagacctacctgctcccgatcggcgcagcgccggagtcacagtcagcccaggctga

SEQ ID NO: 251 - protein, 137 aa, Pseudomonas aeruginosa
SGGKARSMNRHGASHVSTPFLDIQEAVPHPNNQSCPRGIHPSSEQHGTARHASPPAATGEHLAARLAIQAAIRGDLPAATGQLCRAGPAAPCFGKSSPCPSRRDDRSRPGDRGLRTQGTADLPAPDRRSAGVTVSPG

SEQ ID NO: 252 - DNA, 1938 bp, Pseudomonas aeruginosa
atcgtcatggagcctcccatgtttcaactcctttcctggatatccaggaagccgtcccccaccccaacaaccaaagctgccccagggggattcatccttcctctgagcagcatggaactgctcggcacgcctcgccgccggcagctactggagaacatctggcagcgcgcctcgctatccaagcagcaattcgaggagatctaccggcggccactggccaactatgccgagctggtccagcagctccctgcttcggaaaatcatcaccatgcccatccaggcgggatgatcgatcacggcctggagatcgtggcctacgcactcaaggtacggcagacctacctgctcccgatcggcgcagcgccggagtcacagtcagcccaggctgaagcctggtcggccgccgcggcgtatggcgccctggctcatgacataggcaagatcgtcgtcgacctgcaggttgagctacaggacggcagcacctggcacccttggaacggaccgatcaaccagccataccgcttcaagtacgtgaagtcccgcgaataccagctccacggcgctgcctcagcacttctcatccaccaactgctaccgcgcactgcactcgattggctcagtcgctttccagagctgtgggctcaattgatctacctgttcgctgggcagtacgagcacgccgggatcctcggcgagatcatcgtgaaggcagaccaggcctcagttgcacaggagctaggaggcaatccggatcgagctctggctgcaccgaagcagtcgctgcagcggcagttggcagacggccttcgcttcttggtgaaggacaagttcaagttgaatcaacctagcggcccgtctgatggatggctgacccaggacgcactctggctggtgagcaagcctgctgccgatcaactgagagcctacctgctggcccagggtatcgatggggtgccctcctctaacgcgccgttcttcagcatgctccaggaccaagccgtcatccagacaaatgccgaggacaaggccatttggacggccacggtagacaacggtgctggatggagaaacaagttcacgctactcaagattgctccagccttgatctggacagatgctgccgagcgcccctcaccctacagcggatcactggtcgttgaagatggaaccgcctcaacggaaaagccggaaacgacctgtgaaattcccaacgggccggctgaacagcagcaagcaccagaaacgaagatgatgctccatcaacctgcgccgagcgttgcgaaaccggcaaacgagacgcaggcgattgcgaaaccctcaactgatgatcaagaagaaacagacgatttgtatgcacttcttggtaatatcaattcgccactagaagagctagacactagccacgactcgccggctgcctctcctacgaacacacgcggggaggagaacctacagcagccactagggaccaaggagccaacagattgcgctcctgaagcaattgaagatgtatttatgcctagcagaagtactgatctgggacagggattcgttggttggatgaaatctggcatcgcggcccgtcgcctgttcatcaacgacaccaaggctttggtgcataccgtagacgggaccgccatgctggtcacgccaggaattttcaagcgctatgtccaagagcatccggtgcttgaaaaactggcccaagccaaggagacgaccggctggaagctggtgcagcgcgcgttcgaaaaacaggggcttcatcggaagaccagtaaaaacctgaacatctggaccatcaaggtttctggtcctcgcaagacgaaagagctcaaggcctacctgctccaggatcccaaattgctgttccctgagcagcctctggacaacccaagcctcacggtcatcaccgatgccgaaggaggtgtggaatga

SEQ ID NO: 253 - protein, 645 aa, Pseudomonas aeruginosa
IVMEPPMFQLLSWISRKPSPTPTTKAAPGGFILPLSSMELLGTPRRRQLLENIWQRASLSKQQFEEIYRRPLANYAELVQQLPASENHHHAHPGGMIDHGLEIVAYALKVRQTYLLPIGAAPESQSAQAEAWSAAAAYGALAHDIGKIVVDLQVELQDGSTWHPWNGPINQPYRFKYVKSREYQLHGAASALLIHQLLPRTALDWLSRFPELWAQLIYLFAGQYEHAGILGEIIVKADQASVAQELGGNPDRALAAPKQSLQRQLADGLRFLVKDKFKLNQPSGPSDGWLTQDALWLVSKPAADQLRAYLLAQGIDGVPSSNAPFFSMLQDQAVIQTNAEDKAIWTATVDNGAGWRNKFTLLKIAPALIWTDAAERPSPYSGSLVVEDGTASTEKPETTCEIPNGPAEQQQAPETKMMLHQPAPSVAKPANETQAIAKPSTDDQEETDDLYALLGNINSPLEELDTSHDSPAASPTNTRGEENLQQPLGTKEPTDCAPEAIEDVFMPSRSTDLGQGFVGWMKSGIAARRLFINDTKALVHTVDGTAMLVTPGIFKRYVQEHPVLEKLAQAKETTGWKLVQRAFEKQGLHRKTSKNLNIWTIKVSGPRKTKELKAYLLQDPKLLFPEQPLDNPSLTVITDAEGGVE

SEQ ID NO: 254 - DNA, 384 bp, Pseudomonas aeruginosa
gctacaggacggcagcacctggcacccttggaacggaccgatcaaccagccataccgcttcaagtacgtgaagtcccgcgaataccagctccacggcgctgcctcagcacttctcatccaccaactgctaccgcgcactgcactcgattggctcagtcgctttccagagctgtgggctcaattgatctacctgttcgctgggcagtacgagcacgccgggatcctcggcgagatcatcgtgaaggcagaccaggcctcagttgcacaggagctaggaggcaatccggatcgagctctggctgcaccgaagcagtcgctgcagcggcagttggcagacggccttcgcttcttggtgaaggacaagttcaagttgaatcaacctag

SEQ ID NO: 255 - protein, 127 aa, Pseudomonas aeruginosa
ATGRQHLAPLERTDQPAIPLQVREVPRIPAPRRCLSTSHPPTATAHCTRLAQSLSRAVGSIDLPVRWAVRARRDPRRDHREGRPGLSCTGARRQSGSSSGCTEAVAAAAVGRRPSLLGEGQVQVEST

SEQ ID NO: 256 - DNA, 345 bp, Pseudomonas aeruginosa
cgtgaacttgtttctccatccagcaccgttgtctaccgtggccgtccaaatggccttgtcctcggcatttgtctggatgacggcttggtcctggagcatgctgaagaacggcgcgttagaggagggcaccccatcgataccctgggccagcaggtaggctctcagttgatcggcagcaggcttgctcaccagccagagtgcgtcctgggtcagccatccatcagacgggccgctaggttgattcaacttgaacttgtccttcaccaagaagcgaaggccgtctgccaactgccgctgcagcgactgcttcggtgcagccagagctcgatccggattgcctcctag

SEQ ID NO: 257 - protein, 114 aa, Pseudomonas aeruginosa
RELVSPSSTVVYRGRPNGLVLGICLDDGLVLEHAEERRVRGGHPIDTLGQQVGSQLIGSRLAHQPECVLGQPSIRRAARLIQLELVLHQEAKAVCQLPLQRLLRCSQSSIRIAS

SEQ ID NO: 258 - DNA, 339 bp, Pseudomonas aeruginosa
cgcttgaaaattcctggcgtgaccagcatggcggtcccgtctacggtatgcaccaaagccttggtgtcgttgatgaacaggcgacgggccgcgatgccagatttcatccaaccaacgaatccctgtcccagatcagtacttctgctaggcataaatacatcttcaattgcttcaggagcgcaatctgttggctccttggtccctagtggctgctgtaggttctcctccccgcgtgtgttcgtaggagaggcagccggcgagtcgtggctagtgtctagctcttctagtggcgaattgatattaccaagaagtgcatacaaatcgtctgtttcttcttga

SEQ ID NO: 259 - protein, 112 aa, Pseudomonas aeruginosa
RLKIPGVTSMAVPSTVCTKALVSLMNRRRAAMPDFIQPTNPCPRSVLLLGINTSSIASGAQSVGSLVPSGCCRFSSPRVFVGEAAGESWLVSSSSSGELILPRSAYKSSVSS

SEQ ID NO: 260 - DNA, 489 bp, Pseudomonas aeruginosa
gctgctgcggcgtcattccacacctccttcggcatcggtgatgaccgtgaggcttgggttgtccagaggctgctcagggaacagcaatttgggatcctggagcaggtaggccttgagctctttcgtcttgcgaggaccagaaaccttgatggtccagatgttcaggtttttactggtcttccgatgaagcccctgtttttcgaacgcgcgctgcaccagcttccagccggtcgtctccttggcttgggccagtttttcaagcaccggatgctcttggacatagcgcttgaaaattcctggcgtgaccagcatggcggtcccgtctacggtatgcaccaaagccttggtgtcgttgatgaacaggcgacgggccgcgatgccagatttcatccaaccaacgaatccctgtcccagatcagtacttctgctaggcataaatacatcttcaattgcttcaggagcgcaatctgttggctccttggtccctag

SEQ ID NO: 261 - protein, 162 aa, Pseudomonas aeruginosa
AAAASFHTSFGIGDDREAWVVQRLLREQQFGILEQVGLELFRLARTRNLDGPDVQVFTGLPMKPLFFERALHQLPAGRLLGLGQFFKHRMLLDIALENSWRDQHGGPVYGMHQSLGVVDEQATGRDARFHPTNESLSQISTSARHKYIFNCFRSAICWLLGP

SEQ ID NO: 262 - DNA, 396 bp, Pseudomonas aeruginosa
acatctggaccatcaaggtttctggtcctcgcaagacgaaagagctcaaggcctacctgctccaggatcccaaattgctgttccctgagcagcctctggacaacccaagcctcacggtcatcaccgatgccgaaggaggtgtggaatgacgccgcagcagctcaccgaggagtacatcttcgcgcacgatctccgggaagccagcgcgaagatctaccgcgccgcgaccaaggcgctgctcaagcacttcggtcctacggcaaccgtacaggacgtggaccaccgggctgtcctgggatggcgacgcaaggtactggaacaaggcctgtccaagcggagctggaacacgtactcgaatcatctgcggacgatctggggctatgccatcgagcatga

SEQ ID NO: 263 - protein, 131 aa, Pseudomonas aeruginosa
TSGPSRFLVLARRKSSRPTCSRIPNCCSLSSLWTTQASRSSPMPKEVWNDAAAAHRGVHLRARSPGSQREDLPRRDQGAAQALRSYGNRTGRGPPGCPGMATQGTGTRPVQAELEHVLESSADDLGLCHRA

SEQ ID NO: 264 - DNA, 690 bp, Pseudomonas aeruginosa
gtgaggcacaagcccctccgttattggcactacgaactctttgtgagtcttctctgtctcgccgcggatgaggatcagttgattttcccagtcgatgtcgcgcttgcggatgcacaacagcgcattcaaccggatgccggtgaagtagaagacctcaaacgtgcaaagccagaaccaggcgggcgtgatccgtgcgcgttcgccggtgcagcgctctgcgccgtcctgcatgttgagccaattgcgggcgagcaggatggcttcggcggcgacggttttgcttgctcgcctggggggaatgacggtggtctttctgaacgggttgacttgggagtgcgtcaccaactcatgctcgatggcatagccccagatcgtccgcagatgattcgagtacgtgttccagctccgcttggacaggccttgttccagtaccttgcgtcgccatcccaggacagcccggtggtccacgtcctgtacggttgccgtaggaccgaagtgcttgagcagcgccttggtcgcggcgcggtagatcttcgcgctggcttcccggagatcgtgcgcgaagatgtactcctcggtgagctgctgcggcgtcattccacacctccttcggcatcggtgatgaccgtgaggcttgggttgtccagaggctgctcagggaacagcaatttgggatcctggagcaggtag

SEQ ID NO: 265 - protein, 229 aa, Pseudomonas aeruginosa
VRHKPLRYWHYELFVSLLCLAADEDQLIFPVDVALADAQQRIQPDAGEVEDLKRAKPEPGGRDPCAFAGAALCAVLHVEPIAGEQDGFGGDGFACSPGGNDGGLSERVDLGVRHQLMLDGIAPDRPQMIRVRVPAPLGQALFQYLASPSQDSPVVHVLYGCRRTEVLEQRLGRGAVDLRAGFPEIVREDVLLGELLRRHSTPPSASVMTVRLGLSRGCSGNSNLGSWSR

SEQ ID NO: 266 - DNA, 1341 bp, Pseudomonas aeruginosa
gcagcctctggacaacccaagcctcacggtcatcaccgatgccgaaggaggtgtggaatgacgccgcagcagctcaccgaggagtacatcttcgcgcacgatctccgggaagccagcgcgaagatctaccgcgccgcgaccaaggcgctgctcaagcacttcggtcctacggcaaccgtacaggacgtggaccaccgggctgtcctgggatggcgacgcaaggtactggaacaaggcctgtccaagcggagctggaacacgtactcgaatcatctgcggacgatctggggctatgccatcgagcatgagttggtgacgcactcccaagtcaacccgttcagaaagaccaccgtcattccccccaggcgagcaagcaaaaccgtcgccgccgaagccatcctgctcgcccgcaattggctcaacatgcaggacggcgcagagcgctgcaccggcgaacgcgcacggatcacgcccgcctggttctggctttgcacgtttgaggtcttctacttcaccggcatccggttgaatgcgctgttgtgcatccgcaagcgcgacatcgactgggaaaatcaactgatcctcatccgcggcgagacagagaagactcacaaagagttcgtagtgccaataacggaggggcttgtgcctcacctatcgaggctcctgcaagaggccgatagagccggattcgccgatgacgaccagttgttcaacgtcaaccggttctcaccgcactacaagagcaaggtgatgaactccgaccaggtcgaagccatgtaccggaagttgaccgagaaggttggggtgcggatgaccccgcaccgtttccggcacaccctggccaccgacttgatgaaggcacccgagcggaacattcacctcacgaagtgcctgctcaaccactcgaatatccagaccacgatgagctacatcgaggccgactacgatcacatgcgtgccgtgctgcatgctagaagcctggcccaaggcgcgctggagaatgtcaggaaggtggattacagcggctccccgcaagcctctgccaaaccgaagccatgcgggcaacctctcgctcgagtgagtgaagcgccgccaccggaggccaggacagagcctgcagaaccaagggagcacacgccagggacaggcattcagggaggtccaaccgcgtgggaagcagatgcgctaccacagccacctgacaccttcgaaccaagcgtgctgttcactctgatggctcaaaacttatcgaaccgtgccgcctcggcatccgcggctcccgctgcaacaagcggatcaggcggatggggatctgccgcccgaagcaatctcgcctag

SEQ ID NO: 267 - protein, 446 aa, Pseudomonas aeruginosa
AASGQPKPHGHHRCRRRCGMTPQQLTEEYIFAHDLREASAKIYRAATKALLKHFGPTATVQDVDHRAVLGWRRKVLEQGLSKRSWNTYSNHLRTIWGYAIEHELVTHSQVNPFRKTTVIPPRRASKTVAAEAILLARNWLNMQDGAERCTGERARITPAWFWLCTFEVFYFTGIRLNALLCIRKRDIDWENQLILIRGETEKTHKEFVVPITEGLVPHLSRLLQEADRAGFADDDQLFNVNRFSPHYKSKVMNSDQVEAMYRKLTEKVGVRMTPHRFRHTLATDLMKAPERNIHLTKCLLNHSNIQTTMSYIEADYDHMRAVLHARSLAQGALENVRKVDYSGSPQASAKPKPCGQPLARVSEAPPPEARTEPAEPREHTPGTGIQGGPTAWEADALPQPPDTFEPSVLFTLMAQNLSNRAASASAAPAATSGSGGWGSAARSNLA

SEQ ID NO: 268 - DNA, 459 bp, Pseudomonas aeruginosa
cgcatctgcttcccacgcggttggacctccctgaatgcctgtccctggcgtgtgctcccttggttctgcaggctctgtcctggcctccggtggcggcgcttcactcactcgagcgagaggttgcccgcatggcttcggtttggcagaggcttgcggggagccgctgtaatccaccttcctgacattctccagcgcgccttgggccaggcttctagcatgcagcacggcacgcatgtgatcgtagtcggcctcgatgtagctcatcgtggtctggatattcgagtggttgagcaggcacttcgtgaggtgaatgttccgctcgggtgccttcatcaagtcggtggccagggtgtgccggaaacggtgcggggtcatccgcaccccaaccttctcggtcaacttccggtacatggcttcgacctggtcggagttcatcaccttgctcttgtagtgcggtga

SEQ ID NO: 269 - protein, 152 aa, Pseudomonas aeruginosa
RICFPRGWTSLNACPWRVLPWFCRLCPGLRWRRFTHSSERLPAWLRFGRGLRGAAVIHLPDILQRALGQASSMQHGTHVIVVGLDVAHRGLDIRVVEQALREVNVPLGCLHQVGGQGVPETVRGHPHPNLLGQLPVHGFDLVGVHHLALVVR

SEQ ID NO: 270 - DNA, 312 bp, Pseudomonas aeruginosa
caccttcgaaccaagcgtgctgttcactctgatggctcaaaacttatcgaaccgtgccgcctcggcatccgcggctcccgctgcaacaagcggatcaggcggatggggatctgccgcccgaagcaatctcgcctagcgataccggtactgagggccggctaccggacgaaaggtagccgtgccttccagcagatcgttaggcctgtaggaaaaatctggaattaccgagagcgcctggattccagcgccggcatgctggcagagccagcgcaatttcaaggccaataccacagtaccctctgtaatcgctga

SEQ ID NO: 271 - protein, 103 aa, Pseudomonas aeruginosa
HLRTKRAVHSDGSKLIEPCRLGIRGSRCNKRIRRMGICRPKQSRLAIPVLRAGYRTKGSRAFQQIVRPVGKIWNYRERLDSSAGMLAEPAQFQGQYHSTLCNR

SEQ ID NO: 272 - DNA, 2970 bp, Pseudomonas aeruginosa
agagattcgaactcccgacatcctgctcccaaagcaggcgcgctaccggactgcgctataccccgattggaatttggctccgcgacctggactcgaaccagggacccaatgattaacagtcatttgctctaccgactgagctatcgcggaacgtctttcttccaaccctggacgcttccggtgttgctggattcgcgtctcagaggcgcgccattttacggatgcgcgcgggcatgtcaaccctctgatccaaaaagtttttcttctttttccacgagcgacaaaacggcccttccactgcatgcggcagcgctctcgcgcctaccggacgcccatgaaaaagccccgccgaagcggggctttccctgtccgcccccgaagaggtcaggcgaagacgatctcgtcgccttccaccttcgccgagatactggcacccggcgcgaatttgccggccaggatcagttgcgccagcgggttctcgatccagcgctggatggcccgcttcagcgggcgtgcgccatagaccgggtcgaagccgacggcaatcagcttgtccagcgcctcctggctcagttccaggctcagctcgcgctcggccaggcgcttgcgcaggcgaccgagctggatctcggcgatgccggcgatctgctcgcgagccagcggctcgaacaccaccacttcgtcgatccggttgatgaattccggacggaagtgcgcattgaccgcgtccatcactgcggcacgttgcgcctcgcggtcgccggccagctcctggatctgcgccgaaccgaggttggaggtcatcaccaccacggtgttgcggaagtccaccgtacgcccgtgactgtcggtcaggcgtccgtcctcgagcacctggaggagaatgttgaatacatccggatgggccttctccacctcgtccagcagcaccaccgagtagggcttgcggcggatcgcctcggtcaggtagccgccttcctcgaagccgacgtagcccggaggcgcgccgatcaggcgggccaccgagtgtttctccatgaactcggacatatctatccgcaccagcgcctcctcggtatcgaagaggaactcggccagcgccttgcacaactcggtcttgcccaccccggtcgggccgaggaagaggaacgagccgctcggccggttcggatcggcgaggccggcgcgcgaacggcgcacggcgttggacacggcgactaccgcctcgtcctggccgatcactcgccgatgcagctcctgctccatgcgcagcagcttctcgcgctcgccctcgagcatcttcgacaccgggataccggtccacttggaaaccacttcggcgatttcctcgtcggtcaccttgttgcgcagcaactggttctcggtcttgccgtgctggtcgaccatctgcaggctgcgttccaggtccgggatggtctggtactggatgcgcgccatgctctcgaggtcgcccttgcgccgcgccgcctccatctcctgcttggcctgctcgatcttctgctggatctgcgccgagccctgcacctcggccttctcggacttccagatctcctcgaggtcggcgtattcgcgctcgagcttgacgatatcctcctccagcttggccaggcgcttcctggtggcttcgtcgtcttccttcttcagcgcctcgcgctcgatcttcagctggatcaggcgacggtcgagacgatccagttcctccggcttggagtcgatctccatgcggatgcggctggcggcctcgtcgatcaggtcgatggccttgtccggcagttgccgatcggtgatgtagcggtgcgacagcttggccgcggcgatgatcgcgccgtcggtgatgctcaccccgtggtgcacttcatagcgttccttgaggccacggaggatggcgatggtgtcttcctcgctcggttcgtccaccagcaccttctggaagcggcgctccagcgcggcatccttctcgatgtactggcgatactcgtcgagggtagtagcaccgacgcagtgcagctcgccgcgcgccagagccggcttgagcatgttgccggcgtccatggcaccttccgccttgccggcgccgaccatggtgtgcagttcgtcgatgaacaggatgacccggccttcctgcttgcccagttcgttgaggaccgccttcaggcgttcctcgaactcgccgcggaacttggcaccggcgatcagcgcccccatgtccagggccagcaggcgcttgtccttgaggccgtccggcacttcgccgttgatgatgcgctgggccaggccctcgacgatggcggtcttgccgacgccgggttcgccgatcagcaccgggttgttcttggtccgccgctgcaggacctggatggtccggcggatctcgtcgtcgcgaccgatcaccgggtcgagcttgccttcctcggcgcgcttggtcatgtcgacggtgtacttgtccagcgcctggcgcgactcctcgacgttcgggtcgttcaccgcttcgccgccacgcaggttggccacggcattctccagcgccttgcgcgacacgccctggccgagcagcagcttgccgagcctggtgttctcgtccatcgcggccagcaataccagctcgctggagatgaactggtcgcccttctgctgggccaggcggtcagcctggttgagcaggcgtgcgagatcctgggacaggttcacgtcgccggtcgggctctggatcttcggcagcgcgtcgagttctttgttgaggccgctgcgcagggcggcgatatcgaagccgacctgcatcagcaggggcttgatcgaaccgccttgctgctcgagcagggcggaaagcaggtgcaccggctcgatggccggatggtcatggccaacggccagggactgggcgtcggagagcgccagttgcagcttgctggtcaaacggtctattcgcatgggtcgtccttccttctatag

SEQ ID NO: 273 - protein, 989 aa, Pseudomonas aeruginosa
RDSNSRHPAPKAGALPDCAIPRLEFGSATWTRTRDPMINSHLLYRLSYRGTSFFQPWTLPVLLDSRLRGAPFYGCARACQPSDPKSFSSFSTSDKTALPLHAAALSRLPDAHEKAPPKRGFPCPPPKRSGEDDLVAFHLRRDTGTRREFAGQDQLRQRVLDPALDGPLQRACAIDRVEADGNQLVQRLLAQFQAQLALGQALAQATELDLGDAGDLLASQRLEHHHFVDPVDEFRTEVRIDRVHHCGTLRLAVAGQLLDLRRTEVGGHHHHGVAEVHRTPVTVGQASVLEHLEENVEYIRMGLLHLVQQHHRVGLAADRLGQVAAFLEADVARRRADQAGHRVFLHELGHIYPHQRLLGIEEELGQRLAQLGLAHPGRAEEEERAARPVRIGEAGARTAHGVGHGDYRLVLADHSPMQLLLHAQQLLALALEHLRHRDTGPLGNHFGDFLVGHLVAQQLVLGLAVLVDHLQAAFQVRDGLVLDARHALEVALAPRRLHLLLGLLDLLLDLRRALHLGLLGLPDLLEVGVFALELDDILLQLGQALPGGFVVFLLQRLALDLQLDQATVETIQFLRLGVDLHADAAGGLVDQVDGLVRQLPIGDVAVRQLGRGDDRAVGDAHPVVHFIAFLEATEDGDGVFLARFVHQHLLEAALQRGILLDVLAILVEGSSTDAVQLAARQSRLEHVAGVHGTFRLAGADHGVQFVDEQDDPAFLLAQFVEDRLQAFLELAAELGTGDQRPHVQGQQALVLEAVRHFAVDDALGQALDDGGLADAGFADQHRVVLGPPLQDLDGPADLVVATDHRVELAFLGALGHVDGVLVQRLARLLDVRVVHRFAATQVGHGILQRLARHALAEQQLAEPGVLVHRGQQYQLAGDELVALLLGQAVSLVEQACEILGQVHVAGRALDLRQRVEFFVEAAAQGGDIEADLHQQGLDRTALLLEQGGKQVHRLDGRMVMANGQGLGVGERQLQLAGQTVYSHGSSFLL

SEQ ID NO: 274 - DNA, 384 bp, Pseudomonas aeruginosa
gctatcgcggaacgtctttcttccaaccctggacgcttccggtgttgctggattcgcgtctcagaggcgcgccattttacggatgcgcgcgggcatgtcaaccctctgatccaaaaagtttttcttctttttccacgagcgacaaaacggcccttccactgcatgcggcagcgctctcgcgcctaccggacgcccatgaaaaagccccgccgaagcggggctttccctgtccgcccccgaagaggtcaggcgaagacgatctcgtcgccttccaccttcgccgagatactggcacccggcgcgaatttgccggccaggatcagttgcgccagcgggttctcgatccagcgctggatggcccgcttcagcgggcgtgcgccatag

SEQ ID NO: 275 - protein, 127 aa, Pseudomonas aeruginosa
AIAERLSSNPGRFRCCWIRVSEARHFTDARGHVNPLIQKVFLLFPRATKRPFHCMRQRSRAYRTPMKKPRRSGAFPVRPRRGQAKTISSPSTFAEILAPGANLPARISCASGFSIQRWMARFSGRAP

SEQ ID NO: 276 - DNA, 1677 bp, Pseudomonas aeruginosa
agtgcaccacggggtgagcatcaccgacggcgcgatcatcgccgcggccaagctgtcgcaccgctacatcaccgatcggcaactgccggacaaggccatcgacctgatcgacgaggccgccagccgcatccgcatggagatcgactccaagccggaggaactggatcgtctcgaccgtcgcctgatccagctgaagatcgagcgcgaggcgctgaagaaggaagacgacgaagccaccaggaagcgcctggccaagctggaggaggatatcgtcaagctcgagcgcgaatacgccgacctcgaggagatctggaagtccgagaaggccgaggtgcagggctcggcgcagatccagcagaagatcgagcaggccaagcaggagatggaggcggcgcggcgcaagggcgacctcgagagcatggcgcgcatccagtaccagaccatcccggacctggaacgcagcctgcagatggtcgaccagcacggcaagaccgagaaccagttgctgcgcaacaaggtgaccgacgaggaaatcgccgaagtggtttccaagtggaccggtatcccggtgtcgaagatgctcgagggcgagcgcgagaagctgctgcgcatggagcaggagctgcatcggcgagtgatcggccaggacgaggcggtagtcgccgtgtccaacgccgtgcgccgttcgcgcgccggcctcgccgatccgaaccggccgagcggctcgttcctcttcctcggcccgaccggggtgggcaagaccgagttgtgcaaggcgctggccgagttcctcttcgataccgaggaggcgctggtgcggatagatatgtccgagttcatggagaaacactcggtggcccgcctgatcggcgcgcctccgggctacgtcggcttcgaggaaggcggctacctgaccgaggcgatccgccgcaagccctactcggtggtgctgctggacgaggtggagaaggcccatccggatgtattcaacattctcctccaggtgctcgaggacggacgcctgaccgacagtcacgggcgtacggtggacttccgcaacaccgtggtggtgatgacctccaacctcggttcggcgcagatccaggagctggccggcgaccgcgaggcgcaacgtgccgcagtgatggacgcggtcaatgcgcacttccgtccggaattcatcaaccggatcgacgaagtggtggtgttcgagccgctggctcgcgagcagatcgccggcatcgccgagatccagctcggtcgcctgcgcaagcgcctggccgagcgcgagctgagcctggaactgagccaggaggcgctggacaagctgattgccgtcggcttcgacccggtctatggcgcacgcccgctgaagcgggccatccagcgctggatcgagaacccgctggcgcaactgatcctggccggcaaattcgcgccgggtgccagtatctcggcgaaggtggaaggcgacgagatcgtcttcgcctgacctcttcgggggcggacagggaaagccccgcttcggcggggctttttcatgggcgtccggtaggcgcgagagcgctgccgcatgcagtggaagggccgttttgtcgctcgtggaaaaagaagaaaaactttttggatcagagggttgacatgcccgcgcgcatccgtaaaatggcgcgcctctga

SEQ ID NO: 277 - protein, 558 aa, Pseudomonas aeruginosa
SAPRGEHHRRRDHRRGQAVAPLHHRSATAGQGHRPDRRGRQPHPHGDRLQAGGTGSSRPSPDPAEDRARGAEEGRRRSHQEAPGQAGGGYRQARARIRRPRGDLEVREGRGAGLGADPAEDRAGQAGDGGGAAQGRPREHGAHPVPDHPGPGTQPADGRPARQDREPVAAQQGDRRGNRRSGFQVDRYPGVEDARGRAREAAAHGAGAASASDRPGRGGSRRVQRRAPFARRPRRSEPAERLVPLPRPDRGGQDRVVQGAGRVPLRYRGGAGADRYVRVHGETLGGPPDRRASGLRRLRGRRLPDRGDPPQALLGGAAGRGGEGPSGCIQHSPPGARGRTPDRQSRAYGGLPQHRGGDDLQPRFGADPGAGRRPRGATCRSDGRGQCALPSGIHQPDRRSGGVRAAGSRADRRHRRDPARSPAQAPGRARAEPGTEPGGAGQADCRRLRPGLWRTPAEAGHPALDREPAGATDPGRQIRAGCQYLGEGGRRRDRLRLTSSGADRESPASAGLFHGRPVGARALPHAVEGPFCRSWKKKKNFLDQRVDMPARIRKMARL

SEQ ID NO: 278 - DNA, 357 bp, Pseudomonas aeruginosa
aaaagccccgccgaagcggggctttccctgtccgcccccgaagaggtcaggcgaagacgatctcgtcgccttccaccttcgccgagatactggcacccggcgcgaatttgccggccaggatcagttgcgccagcgggttctcgatccagcgctggatggcccgcttcagcgggcgtgcgccatagaccgggtcgaagccgacggcaatcagcttgtccagcgcctcctggctcagttccaggctcagctcgcgctcggccaggcgcttgcgcaggcgaccgagctggatctcggcgatgccggcgatctgctcgcgagccagcggctcgaacaccaccacttcgtcgatccggttga

SEQ ID NO: 279 - protein, 118 aa, Pseudomonas aeruginosa
KSPAEAGLSLSAPEEVRRRRSRRLPPSPRYWHPARICRPGSVAPAGSRSSAGWPASAGVRHRPGRSRRQSACPAPPGSVPGSARARPGACAGDRAGSRRCRRSAREPAARTPPLRRSG

SEQ ID NO: 280 - DNA, 2580 bp, Pseudomonas aeruginosa
aaggaaggacgacccatgcgaatagaccgtttgaccagcaagctgcaactggcgctctccgacgcccagtccctggccgttggccatgaccatccggccatcgagccggtgcacctgctttccgccctgctcgagcagcaaggcggttcgatcaagcccctgctgatgcaggtcggcttcgatatcgccgccctgcgcagcggcctcaacaaagaactcgacgcgctgccgaagatccagagcccgaccggcgacgtgaacctgtcccaggatctcgcacgcctgctcaaccaggctgaccgcctggcccagcagaagggcgaccagttcatctccagcgagctggtattgctggccgcgatggacgagaacaccaggctcggcaagctgctgctcggccagggcgtgtcgcgcaaggcgctggagaatgccgtggccaacctgcgtggcggcgaagcggtgaacgacccgaacgtcgaggagtcgcgccaggcgctggacaagtacaccgtcgacatgaccaagcgcgccgaggaaggcaagctcgacccggtgatcggtcgcgacgacgagatccgccggaccatccaggtcctgcagcggcggaccaagaacaacccggtgctgatcggcgaacccggcgtcggcaagaccgccatcgtcgagggcctggcccagcgcatcatcaacggcgaagtgccggacggcctcaaggacaagcgcctgctggccctggacatgggggcgctgatcgccggtgccaagttccgcggcgagttcgaggaacgcctgaaggcggtcctcaacgaactgggcaagcaggaaggccgggtcatcctgttcatcgacgaactgcacaccatggtcggcgccggcaaggcggaaggtgccatggacgccggcaacatgctcaagccggctctggcgcgcggcgagctgcactgcgtcggtgctactaccctcgacgagtatcgccagtacatcgagaaggatgccgcgctggagcgccgcttccagaaggtgctggtggacgaaccgagcgaggaagacaccatcgccatcctccgtggcctcaaggaacgctatgaagtgcaccacggggtgagcatcaccgacggcgcgatcatcgccgcggccaagctgtcgcaccgctacatcaccgatcggcaactgccggacaaggccatcgacctgatcgacgaggccgccagccgcatccgcatggagatcgactccaagccggaggaactggatcgtctcgaccgtcgcctgatccagctgaagatcgagcgcgaggcgctgaagaaggaagacgacgaagccaccaggaagcgcctggccaagctggaggaggatatcgtcaagctcgagcgcgaatacgccgacctcgaggagatctggaagtccgagaaggccgaggtgcagggctcggcgcagatccagcagaagatcgagcaggccaagcaggagatggaggcggcgcggcgcaagggcgacctcgagagcatggcgcgcatccagtaccagaccatcccggacctggaacgcagcctgcagatggtcgaccagcacggcaagaccgagaaccagttgctgcgcaacaaggtgaccgacgaggaaatcgccgaagtggtttccaagtggaccggtatcccggtgtcgaagatgctcgagggcgagcgcgagaagctgctgcgcatggagcaggagctgcatcggcgagtgatcggccaggacgaggcggtagtcgccgtgtccaacgccgtgcgccgttcgcgcgccggcctcgccgatccgaaccggccgagcggctcgttcctcttcctcggcccgaccggggtgggcaagaccgagttgtgcaaggcgctggccgagttcctcttcgataccgaggaggcgctggtgcggatagatatgtccgagttcatggagaaacactcggtggcccgcctgatcggcgcgcctccgggctacgtcggcttcgaggaaggcggctacctgaccgaggcgatccgccgcaagccctactcggtggtgctgctggacgaggtggagaaggcccatccggatgtattcaacattctcctccaggtgctcgaggacggacgcctgaccgacagtcacgggcgtacggtggacttccgcaacaccgtggtggtgatgacctccaacctcggttcggcgcagatccaggagctggccggcgaccgcgaggcgcaacgtgccgcagtgatggacgcggtcaatgcgcacttccgtccggaattcatcaaccggatcgacgaagtggtggtgttcgagccgctggctcgcgagcagatcgccggcatcgccgagatccagctcggtcgcctgcgcaagcgcctggccgagcgcgagctgagcctggaactgagccaggaggcgctggacaagctgattgccgtcggcttcgacccggtctatggcgcacgcccgctgaagcgggccatccagcgctggatcgagaacccgctggcgcaactgatcctggccggcaaattcgcgccgggtgccagtatctcggcgaaggtggaaggcgacgagatcgtcttcgcctga

SEQ ID NO: 281 - protein, 859 aa, Pseudomonas aeruginosa
KEGRPMRIDRLTSKLQLALSDAQSLAVGHDHPAIEPVHLLSALLEQQGGSIKPLLMQVGFDIAALRSGLNKELDALPKIQSPTGDVNLSQDLARLLNQADRLAQQKGDQFISSELVLLAAMDENTRLGKLLLGQGVSRKALENAVANLRGGEAVNDPNVEESRQALDKYTVDMTKRAEEGKLDPVIGRDDEIRRTIQVLQRRTKNNPVLIGEPGVGKTAIVEGLAQRIINGEVPDGLKDKRLLALDMGALIAGAKFRGEFEERLKAVLNELGKQEGRVILFIDELHTMVGAGKAEGAMDAGNMLKPALARGELHCVGATTLDEYRQYIEKDAALERRFQKVLVDEPSEEDTIAILRGLKERYEVHHGVSITDGAIIAAAKLSHRYITDRQLPDKAIDLIDEAASRIRMEIDSKPEELDRLDRRLIQLKIEREALKKEDDEATRKRLAKLEEDIVKLEREYADLEEIWKSEKAEVQGSAQIQQKIEQAKQEMEAARRKGDLESMARIQYQTIPDLERSLQMVDQHGKTENQLLRNKVTDEEIAEVVSKWTGIPVSKMLEGEREKLLRMEQELHRRVIGQDEAVVAVSNAVRRSRAGLADPNRPSGSFLFLGPTGVGKTELCKALAEFLFDTEEALVRIDMSEFMEKHSVARLIGAPPGYVGFEEGGYLTEAIRRKPYSVVLLDEVEKAHPDVFNILLQVLEDGRLTDSHGRTVDFRNTVVVMTSNLGSAQIQELAGDREAQRAAVMDAVNAHFRPEFINRIDEVVVFEPLAREQIAGIAEIQLGRLRKRLAERELSLELSQEALDKLIAVGFDPVYGARPLKRAIQRWIENPLAQLILAGKFAPGASISAKVEGDEIVFA

SEQ ID NO: 282 - DNA, 321 bp, Pseudomonas aeruginosa
accgggtcgaagccgacggcaatcagcttgtccagcgcctcctggctcagttccaggctcagctcgcgctcggccaggcgcttgcgcaggcgaccgagctggatctcggcgatgccggcgatctgctcgcgagccagcggctcgaacaccaccacttcgtcgatccggttgatgaattccggacggaagtgcgcattgaccgcgtccatcactgcggcacgttgcgcctcgcggtcgccggccagctcctggatctgcgccgaaccgaggttggaggtcatcaccaccacggtgttgcggaagtccaccgtacgcccgtga

SEQ ID NO: 283 - protein, 106 aa, Pseudomonas aeruginosa
TGSKPTAISLSSASWLSSRLSSRSARRLRRRPSWISAMPAICSRASGSNTTTSSIRLMNSGRKCALTASITAARCASRSPASSWICAEPRLEVITTTVLRKSTVRP

SEQ ID NO: 284 - DNA, 819 bp, Pseudomonas aeruginosa
cccggaggcgcgccgatcaggcgggccaccgagtgtttctccatgaactcggacatatctatccgcaccagcgcctcctcggtatcgaagaggaactcggccagcgccttgcacaactcggtcttgcccaccccggtcgggccgaggaagaggaacgagccgctcggccggttcggatcggcgaggccggcgcgcgaacggcgcacggcgttggacacggcgactaccgcctcgtcctggccgatcactcgccgatgcagctcctgctccatgcgcagcagcttctcgcgctcgccctcgagcatcttcgacaccgggataccggtccacttggaaaccacttcggcgatttcctcgtcggtcaccttgttgcgcagcaactggttctcggtcttgccgtgctggtcgaccatctgcaggctgcgttccaggtccgggatggtctggtactggatgcgcgccatgctctcgaggtcgcccttgcgccgcgccgcctccatctcctgcttggcctgctcgatcttctgctggatctgcgccgagccctgcacctcggccttctcggacttccagatctcctcgaggtcggcgtattcgcgctcgagcttgacgatatcctcctccagcttggccaggcgcttcctggtggcttcgtcgtcttccttcttcagcgcctcgcgctcgatcttcagctggatcaggcgacggtcgagacgatccagttcctccggcttggagtcgatctccatgcggatgcggctggcggcctcgtcgatcaggtcgatggccttgtccggcagttgccgatcggtgatgtag

SEQ ID NO: 285 - protein, 272 aa, Pseudomonas aeruginosa
PGGAPIRRATECFSMNSDISIRTSASSVSKRNSASALHNSVLPTPVGPRKRNEPLGRFGSARPARERRTALDTATTASSWPITRRCSSCSMRSSFSRSPSSIFDTGIPVHLETTSAISSSVTLLRSNWFSVLPCWSTICRLRSRSGMVWYWMRAMLSRSPLRRAASISCLACSIFCWICAEPCTSAFSDFQISSRSAYSRSSLTISSSSLARRFLVASSSSFFSASRSIFSWIRRRSRRSSSSGLESISMRMRLAASSIRSMALSGSCRSVM

SEQ ID NO: 286 - DNA, 564 bp, Pseudomonas aeruginosa
actcggacatatctatccgcaccagcgcctcctcggtatcgaagaggaactcggccagcgccttgcacaactcggtcttgcccaccccggtcgggccgaggaagaggaacgagccgctcggccggttcggatcggcgaggccggcgcgcgaacggcgcacggcgttggacacggcgactaccgcctcgtcctggccgatcactcgccgatgcagctcctgctccatgcgcagcagcttctcgcgctcgccctcgagcatcttcgacaccgggataccggtccacttggaaaccacttcggcgatttcctcgtcggtcaccttgttgcgcagcaactggttctcggtcttgccgtgctggtcgaccatctgcaggctgcgttccaggtccgggatggtctggtactggatgcgcgccatgctctcgaggtcgcccttgcgccgcgccgcctccatctcctgcttggcctgctcgatcttctgctggatctgcgccgagccctgcacctcggccttctcggacttccagatctcctcgaggtcggcgtattcgcgctcgagcttga

SEQ ID NO: 287 - protein, 187 aa, Pseudomonas aeruginosa
TRTYLSAPAPPRYRRGTRPAPCTTRSCPPRSGRGRGTSRSAGSDRRGRRANGARRWTRRLPPRPGRSLADAAPAPCAAASRARPRASSTPGYRSTWKPLRRFPRRSPCCAATGSRSCRAGRPSAGCVPGPGWSGTGCAPCSRGRPCAAPPPSPAWPARSSAGSAPSPAPRPSRTSRSPRGRRIRARA

SEQ ID NO: 288 - DNA, 306 bp, Pseudomonas aeruginosa
agaaggaagacgacgaagccaccaggaagcgcctggccaagctggaggaggatatcgtcaagctcgagcgcgaatacgccgacctcgaggagatctggaagtccgagaaggccgaggtgcagggctcggcgcagatccagcagaagatcgagcaggccaagcaggagatggaggcggcgcggcgcaagggcgacctcgagagcatggcgcgcatccagtaccagaccatcccggacctggaacgcagcctgcagatggtcgaccagcacggcaagaccgagaaccagttgctgcgcaacaaggtga

SEQ ID NO: 289 - protein, 101 aa, Pseudomonas aeruginosa
RRKTTKPPGSAWPSWRRISSSSSANTPTSRRSGSPRRPRCRARRRSSRRSSRPSRRWRRRGARATSRAWRASSTRPSRTWNAACRWSTSTARPRTSCCATR

SEQ ID NO: 290 - DNA, 312 bp, Pseudomonas aeruginosa
aggcggtcctcaacgaactgggcaagcaggaaggccgggtcatcctgttcatcgacgaactgcacaccatggtcggcgccggcaaggcggaaggtgccatggacgccggcaacatgctcaagccggctctggcgcgcggcgagctgcactgcgtcggtgctactaccctcgacgagtatcgccagtacatcgagaaggatgccgcgctggagcgccgcttccagaaggtgctggtggacgaaccgagcgaggaagacaccatcgccatcctccgtggcctcaaggaacgctatgaagtgcaccacggggtga

SEQ ID NO: 291 - protein, 103 aa, Pseudomonas aeruginosa
RRSSTNWASRKAGSSCSSTNCTPWSAPARRKVPWTPATCSSRLWRAASCTASVLLPSTSIASTSRRMPRWSAASRRCWWTNRARKTPSPSSVASRNAMKCTTG

SEQ ID NO: 292 - DNA, 789 bp, Pseudomonas aeruginosa
ccgcctggcccagcagaagggcgaccagttcatctccagcgagctggtattgctggccgcgatggacgagaacaccaggctcggcaagctgctgctcggccagggcgtgtcgcgcaaggcgctggagaatgccgtggccaacctgcgtggcggcgaagcggtgaacgacccgaacgtcgaggagtcgcgccaggcgctggacaagtacaccgtcgacatgaccaagcgcgccgaggaaggcaagctcgacccggtgatcggtcgcgacgacgagatccgccggaccatccaggtcctgcagcggcggaccaagaacaacccggtgctgatcggcgaacccggcgtcggcaagaccgccatcgtcgagggcctggcccagcgcatcatcaacggcgaagtgccggacggcctcaaggacaagcgcctgctggccctggacatgggggcgctgatcgccggtgccaagttccgcggcgagttcgaggaacgcctgaaggcggtcctcaacgaactgggcaagcaggaaggccgggtcatcctgttcatcgacgaactgcacaccatggtcggcgccggcaaggcggaaggtgccatggacgccggcaacatgctcaagccggctctggcgcgcggcgagctgcactgcgtcggtgctactaccctcgacgagtatcgccagtacatcgagaaggatgccgcgctggagcgccgcttccagaaggtgctggtggacgaaccgagcgaggaagacaccatcgccatcctccgtggcctcaaggaacgctatga

SEQ ID NO: 293 - protein, 262 aa, Pseudomonas aeruginosa
PPGPAEGRPVHLQRAGIAGRDGREHQARQAAARPGRVAQGAGECRGQPAWRRSGERPERRGVAPGAGQVHRRHDQARRGRQARPGDRSRRRDPPDHPGPAAADQEQPGADRRTRRRQDRHRRGPGPAHHQRRSAGRPQGQAPAGPGHGGADRRCQVPRRVRGTPEGGPQRTGQAGRPGHPVHRRTAHHGRRRQGGRCHGRRQHAQAGSGARRAALRRCYYPRRVSPVHREGCRAGAPLPEGAGGRTERGRHHRHPPWPQGTL

SEQ ID NO: 294 - DNA, 1116 bp, Pseudomonas aeruginosa
cgttccttgaggccacggaggatggcgatggtgtcttcctcgctcggttcgtccaccagcaccttctggaagcggcgctccagcgcggcatccttctcgatgtactggcgatactcgtcgagggtagtagcaccgacgcagtgcagctcgccgcgcgccagagccggcttgagcatgttgccggcgtccatggcaccttccgccttgccggcgccgaccatggtgtgcagttcgtcgatgaacaggatgacccggccttcctgcttgcccagttcgttgaggaccgccttcaggcgttcctcgaactcgccgcggaacttggcaccggcgatcagcgcccccatgtccagggccagcaggcgcttgtccttgaggccgtccggcacttcgccgttgatgatgcgctgggccaggccctcgacgatggcggtcttgccgacgccgggttcgccgatcagcaccgggttgttcttggtccgccgctgcaggacctggatggtccggcggatctcgtcgtcgcgaccgatcaccgggtcgagcttgccttcctcggcgcgcttggtcatgtcgacggtgtacttgtccagcgcctggcgcgactcctcgacgttcgggtcgttcaccgcttcgccgccacgcaggttggccacggcattctccagcgccttgcgcgacacgccctggccgagcagcagcttgccgagcctggtgttctcgtccatcgcggccagcaataccagctcgctggagatgaactggtcgcccttctgctgggccaggcggtcagcctggttgagcaggcgtgcgagatcctgggacaggttcacgtcgccggtcgggctctggatcttcggcagcgcgtcgagttctttgttgaggccgctgcgcagggcggcgatatcgaagccgacctgcatcagcaggggcttgatcgaaccgccttgctgctcgagcagggcggaaagcaggtgcaccggctcgatggccggatggtcatggccaacggccagggactgggcgtcggagagcgccagttgcagcttgctggtcaaacggtctattcgcatgggtcgtccttccttctatagagcgggccggaacgatgggtgtccctga

SEQ ID NO: 295 - protein, 371 aa, Pseudomonas aeruginosa
RSLRPRRMAMVSSSLGSSTSTFWKRRSSAASFSMYWRYSSRVVAPTQCSSPRARAGLSMLPASMAPSALPAPTMVCSSSMNRMTRPSCLPSSLRTAFRRSSNSPRNLAPAISAPMSRASRRLSLRPSGTSPLMMRWARPSTMAVLPTPGSPISTGLFLVRRCRTWMVRRISSSRPITGSSLPSSARLVMSTVYLSSAWRDSSTFGSFTASPPRRLATAFSSALRDTPWPSSSLPSLVFSSIAASNTSSLEMNWSPFCWARRSAWLSRRARSWDRFTSPVGLWIFGSASSSLLRPLRRAAISKPTCISRGLIEPPCCSSRAESRCTGSMAGWSWPTARDWASESASCSLLVKRSIRMGRPSFYRAGRNDGCP

SEQ ID NO: 296 - DNA, 354 bp, Pseudomonas aeruginosa
tgcgctgggccaggccctcgacgatggcggtcttgccgacgccgggttcgccgatcagcaccgggttgttcttggtccgccgctgcaggacctggatggtccggcggatctcgtcgtcgcgaccgatcaccgggtcgagcttgccttcctcggcgcgcttggtcatgtcgacggtgtacttgtccagcgcctggcgcgactcctcgacgttcgggtcgttcaccgcttcgccgccacgcaggttggccacggcattctccagcgccttgcgcgacacgccctggccgagcagcagcttgccgagcctggtgttctcgtccatcgcggccagcaataccagctcgctggagatga

SEQ ID NO: 297 - protein, 117 aa, Pseudomonas aeruginosa
CAGPGPRRWRSCRRRVRRSAPGCSWSAAAGPGWSGGSRRRDRSPGRACLPRRAWSCRRCTCPAPGATPRRSGRSPLRRHAGWPRHSPAPCATRPGRAAACRAWCSRPSRPAIPARWR

SEQ ID NO: 298 - DNA, 513 bp, Pseudomonas aeruginosa
ccgccgactgcctgccggcgttgttctgcgaccgctcgggcacccgggtggccgcggcccatgccggctggcgcgggctggcggcgggcgtgctggaggcgacggtggacagcctgggcgtgcccggcgacgaactgctggtctggctggggccggcgatcggcccgcaggccttcgaggtcggcggcgaggtccgcgatgcattcgtcgctgcgcacgccgaggcgcgctcggctttcgtacctagcgccaatccgggccgcttcatggccgacatctaccgactcgcgcggatccgcctgggcgcccatggcgtcaccgccgtgcatggcggcggcttctgcaccttcagcgataccgcgcgcttctattcctaccgccgctcgtcgcgtaccggccgttttgccagcctggtctggctccaggactaggcccgcgcaggttatccggcggcaactgaccgatgtcacggtccggtcgcttgaaccgcggaaaatcgcccttatctactga

SEQ ID NO: 299 - protein, 170 aa, Pseudomonas aeruginosa
PPTACRRCSATARAPGWPRPMPAGAGWRRACWRRRWTAWACPATNCWSGWGRRSARRPSRSAARSAMHSSLRTPRRARLSYLAPIRAASWPTSTDSRGSAWAPMASPPCMAAASAPSAIPRASIPTAARRVPAVLPAWSGSRTRPAQVIRRQLTDVTVRSLEPRKIALIY

SEQ ID NO: 300 - DNA, 726 bp, Pseudomonas aeruginosa
ataagggcgattttccgcggttcaagcgaccggaccgtgacatcggtcagttgccgccggataacctgcgcgggcctagtcctggagccagaccaggctggcaaaacggccggtacgcgacgagcggcggtaggaatagaagcgcgcggtatcgctgaaggtgcagaagccgccgccatgcacggcggtgacgccatgggcgcccaggcggatccgcgcgagtcggtagatgtcggccatgaagcggcccggattggcgctaggtacgaaagccgagcgcgcctcggcgtgcgcagcgacgaatgcatcgcggacctcgccgccgacctcgaaggcctgcgggccgatcgccggccccagccagaccagcagttcgtcgccgggcacgcccaggctgtccaccgtcgcctccagcacgcccgccgccagcccgcgccagccggcatgggccgcggccacccgggtgcccgagcggtcgcagaacaacgccggcaggcagtcggcggtcatgatcgtacaggcgacgcccggcatcgcgctccagctggcgtcggccctgagcaccggttcgggtcggcctccaccacgtcactccgtgcacctattccaaccagctcggccggcattccagacgctcggtcaggcgtcggcggttttattccacggcgcgcggatcgtcgtagacgtgggcgccaaggttcagactgtcgaagggtgcctggctga

SEQ ID NO: 301 - protein, 241 aa, Pseudomonas aeruginosa
IRAIFRGSSDRTVTSVSCRRITCAGLVLEPDQAGKTAGTRRAAVGIEARGIAEGAEAAAMHGGDAMGAQADPRESVDVGHEAARIGARYESRARLGVRSDECIADLAADLEGLRADRRPQPDQQFVAGHAQAVHRRLQHARRQPAPAGMGRGHPGARAVAEQRRQAVGGHDRTGDARHRAPAGVGPEHRFGSASTTSLRAPIPTSSAGIPDARSGVGGFIPRRADRRRRGRQGSDCRRVPG

SEQ ID NO: 302 - DNA, 513 bp, Pseudomonas aeruginosa
cgtggtggaggccgacccgaaccggtgctcagggccgacgccagctggagcgcgatgccgggcgtcgcctgtacgatcatgaccgccgactgcctgccggcgttgttctgcgaccgctcgggcacccgggtggccgcggcccatgccggctggcgcgggctggcggcgggcgtgctggaggcgacggtggacagcctgggcgtgcccggcgacgaactgctggtctggctggggccggcgatcggcccgcaggccttcgaggtcggcggcgaggtccgcgatgcattcgtcgctgcgcacgccgaggcgcgctcggctttcgtacctagcgccaatccgggccgcttcatggccgacatctaccgactcgcgcggatccgcctgggcgcccatggcgtcaccgccgtgcatggcggcggcttctgcaccttcagcgataccgcgcgcttctattcctaccgccgctcgtcgcgtaccggccgttttgccagcctggtctggctccaggactag

SEQ ID NO: 303 - protein, 170 aa, Pseudomonas aeruginosa
RGGGRPEPVLRADASWSAMPGVACTIMTADCLPALFCDRSGTRVAAAHAGWRGLAAGVLEATVDSLGVPGDELLVWLGPAIGPQAFEVGGEVRDAFVAAHAEARSAFVPSANPGRFMADIYRLARIRLGAHGVTAVHGGGFCTFSDTARFYSYRRSSRTGRFASLVWLQD

SEQ ID NO: 304 - DNA, 675 bp, Pseudomonas aeruginosa
atgtcggccatgaagcggcccggattggcgctaggtacgaaagccgagcgcgcctcggcgtgcgcagcgacgaatgcatcgcggacctcgccgccgacctcgaaggcctgcgggccgatcgccggccccagccagaccagcagttcgtcgccgggcacgcccaggctgtccaccgtcgcctccagcacgcccgccgccagcccgcgccagccggcatgggccgcggccacccgggtgcccgagcggtcgcagaacaacgccggcaggcagtcggcggtcatgatcgtacaggcgacgcccggcatcgcgctccagctggcgtcggccctgagcaccggttcgggtcggcctccaccacgtcactccgtgcacctattccaaccagctcggccggcattccagacgctcggtcaggcgtcggcggttttattccacggcgcgcggatcgtcgtagacgtgggcgccaaggttcagactgtcgaagggtgcctggctgaccccgccactgcgcgtggtcacgcaggcccgcacacgggccggcgccggccagtcgggggtcagccaggcgttcaaccgacgaacgcctcgcgatcctggcgcaacaggctgagcagccagaggaattcttccggcagcggcgattcccacttcatgcgcacgccggtggccgggtga

SEQ ID NO: 305 - protein, 224 aa, Pseudomonas aeruginosa
MSAMKRPGLALGTKAERASACAATNASRTSPPTSKACGPIAGPSQTSSSSPGTPRLSTVASSTPAASPRQPAWAAATRVPERSQNNAGRQSAVMIVQATPGIALQLASALSTGSGRPPPRHSVHLFQPARPAFQTLGQASAVLFHGARIVVDVGAKVQTVEGCLADPATARGHAGPHTGRRRPVGGQPGVQPTNASRSWRNRLSSQRNSSGSGDSHFMRTPVAG

SEQ ID NO: 306 - DNA, 342 bp, Pseudomonas aeruginosa
gtgcacggagtgacgtggtggaggccgacccgaaccggtgctcagggccgacgccagctggagcgcgatgccgggcgtcgcctgtacgatcatgaccgccgactgcctgccggcgttgttctgcgaccgctcgggcacccgggtggccgcggcccatgccggctggcgcgggctggcggcgggcgtgctggaggcgacggtggacagcctgggcgtgcccggcgacgaactgctggtctggctggggccggcgatcggcccgcaggccttcgaggtcggcggcgaggtccgcgatgcattcgtcgctgcgcacgccgaggcgcgctcggctttcgtacctag

SEQ ID NO: 307 - protein, 113 aa, Pseudomonas aeruginosa
VHGVTWWRPTRTGAQGRRQLERDAGRRLYDHDRRLPAGVVLRPLGHPGGRGPCRLARAGGGRAGGDGGQPGRARRRTAGLAGAGDRPAGLRGRRRGPRCIRRCARRGALGFRT

SEQ ID NO: 308 - DNA, 372 bp, Pseudomonas aeruginosa
agtgggaatcgccgctgccggaagaattcctctggctgctcagcctgttgcgccaggatcgcgaggcgttcgtcggttgaacgcctggctgacccccgactggccggcgccggcccgtgtgcgggcctgcgtgaccacgcgcagtggcggggtcagccaggcacccttcgacagtctgaaccttggcgcccacgtctacgacgatccgcgcgccgtggaataaaaccgccgacgcctgaccgagcgtctggaatgccggccgagctggttggaataggtgcacggagtgacgtggtggaggccgacccgaaccggtgctcagggccgacgccagctggagcgcgatgccgggcgtcgcctgtacgatcatga

SEQ ID NO: 309 - protein, 123 aa, Pseudomonas aeruginosa
SGNRRCRKNSSGCSACCARIARRSSVERLADPRLAGAGPCAGLRDHAQWRGQPGTLRQSEPWRPRLRRSARRGIKPPTPDRASGMPAELVGIGARSDVVEADPNRCSGPTPAGARCRASPVRS

SEQ ID NO: 310 - DNA, 819 bp, Pseudomonas aeruginosa
caagcccgccggcctggtggtccatccggctgccggccatcaggacggcaccctgctgaatgccttgctctaccatgtcccggacatcgccaatgtgccgcgcgccgggatcgtccaccgcctggacaaggacacgaccggcctgatggtagtggccaagacgctggaggcccacaccaagctggtggcgcaactgcaggcacggtcggtcagccgcatctacgaggcgatcgtgatcggcgtgatcacctccggcggcaccatcgatgcgccgatcggacggcatggcgtgcagcggcagaagatggcggtggtcgacgccggcaaggtggcggtcagccattaccgcgtgctggaacgcttccgtgcgcacacccatacccgggtcaagctggagaccgggcgtacccaccagatccgcgtgcacatgagccatattggctatcccctggtcggcgatccggtctacggtgggcgcttcaggattcccccggtggccagccagaccctggtccagactcttcgcgaattcccccggcaggcgctgcacgcgcgcttcctcgaactggatcacccggccaccggcgtgcgcatgaagtgggaatcgccgctgccggaagaattcctctggctgctcagcctgttgcgccaggatcgcgaggcgttcgtcggttgaacgcctggctgacccccgactggccggcgccggcccgtgtgcgggcctgcgtgaccacgcgcagtggcggggtcagccaggcacccttcgacagtctgaaccttggcgcccacgtctacgacgatccgcgcgccgtggaataa

SEQ ID NO: 311 - protein, 272 aa, Pseudomonas aeruginosa
QARRPGGPSGCRPSGRHPAECLALPCPGHRQCAARRDRPPPGQGHDRPDGSGQDAGGPHQAGGATAGTVGQPHLRGDRDRRDHLRRHHRCADRTAWRAAAEDGGGRRRQGGGQPLPRAGTLPCAHPYPGQAGDRAYPPDPRAHEPYWLSPGRRSGLRWALQDSPGGQPDPGPDSSRIPPAGAARALPRTGSPGHRRAHEVGIAAAGRIPLAAQPVAPGSRGVRRLNAWLTPDWPAPARVRACVTTRSGGVSQAPFDSLNLGAHVYDDPRAVE

SEQ ID NO: 312 - DNA, 1041 bp, Pseudomonas aeruginosa
ccccgccactgcgcgtggtcacgcaggcccgcacacgggccggcgccggccagtcgggggtcagccaggcgttcaaccgacgaacgcctcgcgatcctggcgcaacaggctgagcagccagaggaattcttccggcagcggcgattcccacttcatgcgcacgccggtggccgggtgatccagttcgaggaagcgcgcgtgcagcgcctgccgggggaattcgcgaagagtctggaccagggtctggctggccaccgggggaatcctgaagcgcccaccgtagaccggatcgccgaccaggggatagccaatatggctcatgtgcacgcggatctggtgggtacgcccggtctccagcttgacccgggtatgggtgtgcgcacggaagcgttccagcacgcggtaatggctgaccgccaccttgccggcgtcgaccaccgccatcttctgccgctgcacgccatgccgtccgatcggcgcatcgatggtgccgccggaggtgatcacgccgatcacgatcgcctcgtagatgcggctgaccgaccgtgcctgcagttgcgccaccagcttggtgtgggcctccagcgtcttggccactaccatcaggccggtcgtgtccttgtccaggcggtggacgatcccggcgcgcggcacattggcgatgtccgggacatggtagagcaaggcattcagcagggtgccgtcctgatggccggcagccggatggaccaccaggccggcgggcttgtcaatcaccaggatgtgctcgtcctcgtagacgatttccagctcgatgtcctgtgcgagccactcgccctgggcttcctgctcggcctccaggaccagttgcgcgccgctgtggacgatgtcgcgcgggcgcagcacggcgccgtcgacggtcaggcgaccgtccttgatccagccggccagacgggagcgggagtgttcgggaaaaagctgggcggcgatctggtcgagacgctggccacccagctcgaacggcacctcggccgcgcgttgaatcatatcggacatgagtag

SEQ ID NO: 313 - protein, 346 aa, Pseudomonas aeruginosa
PRHCAWSRRPAHGPAPASRGSARRSTDERLAILAQQAEQPEEFFRQRRFPLHAHAGGRVIQFEEARVQRLPGEFAKSLDQGLAGHRGNPEAPTVDRIADQGIANMAHVHADLVGTPGLQLDPGMGVRTEAFQHAVMADRHLAGVDHRHLLPLHAMPSDRRIDGAAGGDHADHDRLVDAADRPCLQLRHQLGVGLQRLGHYHQAGRVLVQAVDDPGARHIGDVRDMVEQGIQQGAVLMAGSRMDHQAGGLVNHQDVLVLVDDFQLDVLCEPLALGFLLGLQDQLRAAVDDVARAQHGAVDGQATVLDPAGQTGAGVFGKKLGGDLVETLATQLERHLGRALNHIGHE

SEQ ID NO: 314 - DNA, 1014 bp, Pseudomonas aeruginosa
ccacagcgcgtagccgattccaaaagccgcgctgagcatcgtctcctactcatgtccgatatgattcaacgcgcggccgaggtgccgttcgagctgggtggccagcgtctcgaccagatcgccgcccagctttttcccgaacactcccgctcccgtctggccggctggatcaaggacggtcgcctgaccgtcgacggcgccgtgctgcgcccgcgcgacatcgtccacagcggcgcgcaactggtcctggaggccgagcaggaagcccagggcgagtggctcgcacaggacatcgagctggaaatcgtctacgaggacgagcacatcctggtgattgacaagcccgccggcctggtggtccatccggctgccggccatcaggacggcaccctgctgaatgccttgctctaccatgtcccggacatcgccaatgtgccgcgcgccgggatcgtccaccgcctggacaaggacacgaccggcctgatggtagtggccaagacgctggaggcccacaccaagctggtggcgcaactgcaggcacggtcggtcagccgcatctacgaggcgatcgtgatcggcgtgatcacctccggcggcaccatcgatgcgccgatcggacggcatggcgtgcagcggcagaagatggcggtggtcgacgccggcaaggtggcggtcagccattaccgcgtgctggaacgcttccgtgcgcacacccatacccgggtcaagctggagaccgggcgtacccaccagatccgcgtgcacatgagccatattggctatcccctggtcggcgatccggtctacggtgggcgcttcaggattcccccggtggccagccagaccctggtccagactcttcgcgaattcccccggcaggcgctgcacgcgcgcttcctcgaactggatcacccggccaccggcgtgcgcatgaagtgggaatcgccgctgccggaagaattcctctggctgctcagcctgttgcgccaggatcgcgaggcgttcgtcggttga

SEQ ID NO: 315 - protein, 337 aa, Pseudomonas aeruginosa
PQRVADSKSRAEHRLLLMSDMIQRAAEVPFELGGQRLDQIAAQLFPEHSRSRLAGWIKDGRLTVDGAVLRPRDIVHSGAQLVLEAEQEAQGEWLAQDIELEIVYEDEHILVIDKPAGLVVHPAAGHQDGTLLNALLYHVPDIANVPRAGIVHRLDKDTTGLMVVAKTLEAHTKLVAQLQARSVSRIYEAIVIGVITSGGTIDAPIGRHGVQRQKMAVVDAGKVAVSHYRVLERFRAHTHTRVKLETGRTHQIRVHMSHIGYPLVGDPVYGGRFRIPPVASQTLVQTLREFPRQALHARFLELDHPATGVRMKWESPLPEEFLWLLSLLRQDREAFVG

SEQ ID NO: 316 - DNA, 378 bp, Pseudomonas aeruginosa
ccgaccgtgcctgcagttgcgccaccagcttggtgtgggcctccagcgtcttggccactaccatcaggccggtcgtgtccttgtccaggcggtggacgatcccggcgcgcggcacattggcgatgtccgggacatggtagagcaaggcattcagcagggtgccgtcctgatggccggcagccggatggaccaccaggccggcgggcttgtcaatcaccaggatgtgctcgtcctcgtagacgatttccagctcgatgtcctgtgcgagccactcgccctgggcttcctgctcggcctccaggaccagttgcgcgccgctgtggacgatgtcgcgcgggcgcagcacggcgccgtcgacggtcaggcgaccgtccttga

SEQ ID NO: 317 - protein, 125 aa, Pseudomonas aeruginosa
PTVPAVAPPAWCGPPASWPLPSGRSCPCPGGGRSRRAAHWRCPGHGRARHSAGCRPDGRQPDGPPGRRACQSPGCARPRRRFPARCPVRATRPGLPARPPGPVARRCGRCRAGAARRRRRSGDRP

SEQ ID NO: 318 - DNA, 303 bp, Pseudomonas aeruginosa
gcatcgtctcctactcatgtccgatatgattcaacgcgcggccgaggtgccgttcgagctgggtggccagcgtctcgaccagatcgccgcccagctttttcccgaacactcccgctcccgtctggccggctggatcaaggacggtcgcctgaccgtcgacggcgccgtgctgcgcccgcgcgacatcgtccacagcggcgcgcaactggtcctggaggccgagcaggaagcccagggcgagtggctcgcacaggacatcgagctggaaatcgtctacgaggacgagcacatcctggtgattga

SEQ ID NO: 319 - protein, 100 aa, Pseudomonas aeruginosa
ASSPTHVRYDSTRGRGAVRAGWPASRPDRRPAFSRTLPLPSGRLDQGRSPDRRRRRAAPARHRPQRRATGPGGRAGSPGRVARTGHRAGNRLRGRAHPGD

SEQ ID NO: 320 - DNA, 1590 bp, Pseudomonas aeruginosa
tcttccagttcgctggagatcagcaggaccagtaccaggccgatggtcaggcggtacaggtggtacagacggaggatgcgttgcccctgctcctcgctcagccgtagccgttcagcgcgcacggtcgccctggtcctggcgcaggtgcgcctggctgcaataccagcgttgttcgtgggcgagggcgttggcctgcggcacgtggacgccgcaatgggcgcagcggaccatcggcgatgcgctcggctcgtcctgcggacgttgctgctggcgcggagtgggacgggtaaagcgacgccagagccagaacgcgatggcgatcagggcgatccagaacaggaggcggaaaaggcccatggtgatctcggaggctggagaaagctgcagtttagccaagccgccggctcgatcccagacgggaaggtccaggctgtgcggcgtttggcgctgggagaggcatggcggcgggcaaaaagaagggaggcctgcgcctcccttcggtgtttcgtgcgatcagtcgaagagaccgaaggtcatgtagctccaccaggagcgaccggagtcctcgtcgtcatcgctctccggcttctcgtcgtcggcgctgtgatcctggttttccggcttcagttcggcggggatctcccgctcggcatcctcgtactgcttgatcacgtccttggcggcctgggtttccatgtgcggcggcggctcgccgccttcgatcaggcccagggtggccttggccagccaggagcgggtgtcggcctcgctttcgcgggcgacgaactcgccatccttgaggctggcgttatccggatagttcagcttgagggtttccaggctggtgctggccaggtcgtcgagacccaggcgacggtaggcttcgaccatgatcgccaggccatcgccgacggccggggtttcctggaagttctccaccacgtagcgaccgcggttggcggcggcgacataggcctggcgcttcaggtagtagtggccgacgtgcacttcgtaggccgccagcaggttgcgcaggtacaccatgcgcgccttggcgtccggggcgtagcggctgttggggaagcggctggtgagctgggcgaactcgttgaaggagtcgcgggcggcgcccgggtcgcgcttggtcatgtccagcggcaggaagcgcgccagcaggccgcggtcctggtcgaaggaggacaggcctttgaggtagtaggcgtagtcgacgttggggtgctgcggatgcaggcggatgaagcgttcggcggcggcgcgggcggcttcgggctccatgttcttgtagttggcgtagatcagctcgagctgggcctgctcggcgtagcggccgaagggatagcgcgattcgagggctttcagcttggtgacggcgctgttgtagctcttgttgttgaggtcgtcctgcgcctgctggtacagctggctctcgctcaggttctcgtcgacagtctccttgttcgaggagcaggctgcggtgagggcgaggatggcgatcagcagcaggtgtttcacttgcatggcggcttgcgtccctgggacggtcggcttggcctcaaccgtctgttatga

SEQ ID NO: 321 - protein, 529 aa, Pseudomonas aeruginosa
SSSSLEISRTSTRPMVRRYRWYRRRMRCPCSSLSRSRSARTVALVLAQVRLAAIPALFVGEGVGLRHVDAAMGAADHRRCARLVLRTLLLARSGTGKATPEPERDGDQGDPEQEAEKAHGDLGGWRKLQFSQAAGSIPDGKVQAVRRLALGEAWRRAKRREACASLRCFVRSVEETEGHVAPPGATGVLVVIALRLLVVGAVILVFRLQFGGDLPLGILVLLDHVLGGLGFHVRRRLAAFDQAQGGLGQPGAGVGLAFAGDELAILEAGVIRIVQLEGFQAGAGQVVETQATVGFDHDRQAIADGRGFLEVLHHVATAVGGGDIGLALQVVVADVHFVGRQQVAQVHHARLGVRGVAAVGEAAGELGELVEGVAGGARVALGHVQRQEARQQAAVLVEGGQAFEVVGVVDVGVLRMQADEAFGGGAGGFGLHVLVVGVDQLELGLLGVAAEGIARFEGFQLGDGAVVALVVEVVLRLLVQLALAQVLVDSLLVRGAGCGEGEDGDQQQVFHLHGGLRPWDGRLGLNRLL

SEQ ID NO: 322 - DNA, 1071 bp, Pseudomonas aeruginosa
cagacggttgaggccaagccgaccgtcccagggacgcaagccgccatgcaagtgaaacacctgctgctgatcgccatcctcgccctcaccgcagcctgctcctcgaacaaggagactgtcgacgagaacctgagcgagagccagctgtaccagcaggcgcaggacgacctcaacaacaagagctacaacagcgccgtcaccaagctgaaagccctcgaatcgcgctatcccttcggccgctacgccgagcaggcccagctcgagctgatctacgccaactacaagaacatggagcccgaagccgcccgcgccgccgccgaacgcttcatccgcctgcatccgcagcaccccaacgtcgactacgcctactacctcaaaggcctgtcctccttcgaccaggaccgcggcctgctggcgcgcttcctgccgctggacatgaccaagcgcgacccgggcgccgcccgcgactccttcaacgagttcgcccagctcaccagccgcttccccaacagccgctacgccccggacgccaaggcgcgcatggtgtacctgcgcaacctgctggcggcctacgaagtgcacgtcggccactactacctgaagcgccaggcctatgtcgccgccgccaaccgcggtcgctacgtggtggagaacttccaggaaaccccggccgtcggcgatggcctggcgatcatggtcgaagcctaccgtcgcctgggtctcgacgacctggccagcaccagcctggaaaccctcaagctgaactatccggataacgccagcctcaaggatggcgagttcgtcgcccgcgaaagcgaggccgacacccgctcctggctggccaaggccaccctgggcctgatcgaaggcggcgagccgccgccgcacatggaaacccaggccgccaaggacgtgatcaagcagtacgaggatgccgagcgggagatccccgccgaactgaagccggaaaaccaggatcacagcgccgacgacgagaagccggagagcgatgacgacgaggactccggtcgctcctggtggagctacatgaccttcggtctcttcgactga

SEQ ID NO: 323 - protein, 356 aa, Pseudomonas aeruginosa
QTVEAKPTVPGTQAAMQVKHLLLIAILALTAACSSNKETVDENLSESQLYQQAQDDLNNKSYNSAVTKLKALESRYPFGRYAEQAQLELIYANYKNMEPEAARAAAERFIRLHPQHPNVDYAYYLKGLSSFDQDRGLLARFLPLDMTKRDPGAARDSFNEFAQLTSRFPNSRYAPDAKARMVYLRNLLAAYEVHVGHYYLKRQAYVAAANRGRYVVENFQETPAVGDGLAIMVEAYRRLGLDDLASTSLETLKLNYPDNASLKDGEFVARESEADTRSWLAKATLGLIEGGEPPPHMETQAAKDVIKQYEDAEREIPAELKPENQDHSADDEKPESDDDEDSGRSWWSYMTFGLFD

SEQ ID NO: 324 - DNA, 765 bp, Pseudomonas aeruginosa
ggccaagccgaccgtcccagggacgcaagccgccatgcaagtgaaacacctgctgctgatcgccatcctcgccctcaccgcagcctgctcctcgaacaaggagactgtcgacgagaacctgagcgagagccagctgtaccagcaggcgcaggacgacctcaacaacaagagctacaacagcgccgtcaccaagctgaaagccctcgaatcgcgctatcccttcggccgctacgccgagcaggcccagctcgagctgatctacgccaactacaagaacatggagcccgaagccgcccgcgccgccgccgaacgcttcatccgcctgcatccgcagcaccccaacgtcgactacgcctactacctcaaaggcctgtcctccttcgaccaggaccgcggcctgctggcgcgcttcctgccgctggacatgaccaagcgcgacccgggcgccgcccgcgactccttcaacgagttcgcccagctcaccagccgcttccccaacagccgctacgccccggacgccaaggcgcgcatggtgtacctgcgcaacctgctggcggcctacgaagtgcacgtcggccactactacctgaagcgccaggcctatgtcgccgccgccaaccgcggtcgctacgtggtggagaacttccaggaaaccccggccgtcggcgatggcctggcgatcatggtcgaagcctaccgtcgcctgggtctcgacgacctggccagcaccagcctggaaaccctcaagctgaactatccggataa

SEQ ID NO: 325 - protein, 254 aa, Pseudomonas aeruginosa
GQADRPRDASRHASETPAADRHPRPHRSLLLEQGDCRREPEREPAVPAGAGRPQQQELQQRRHQAESPRIALSLRPLRRAGPARADLRQLQEHGARSRPRRRRTLHPPASAAPQRRLRLLPQRPVLLRPGPRPAGALPAAGHDQARPGRRPRLLQRVRPAHQPLPQQPLRPGRQGAHGVPAQPAGGLRSARRPLLPEAPGLCRRRQPRSLRGGELPGNPGRRRWPGDHGRSLPSPGSRRPGQHQPGNPQAELSG

SEQ ID NO: 326 - DNA, 549 bp, Pseudomonas aeruginosa
ggacctgatcttccagttcgctggagatcagcaggaccagtaccaggccgatggtcaggcggtacaggtggtacagacggaggatgcgttgcccctgctcctcgctcagccgtagccgttcagcgcgcacggtcgccctggtcctggcgcaggtgcgcctggctgcaataccagcgttgttcgtgggcgagggcgttggcctgcggcacgtggacgccgcaatgggcgcagcggaccatcggcgatgcgctcggctcgtcctgcggacgttgctgctggcgcggagtgggacgggtaaagcgacgccagagccagaacgcgatggcgatcagggcgatccagaacaggaggcggaaaaggcccatggtgatctcggaggctggagaaagctgcagtttagccaagccgccggctcgatcccagacgggaaggtccaggctgtgcggcgtttggcgctgggagaggcatggcggcgggcaaaaagaagggaggcctgcgcctcccttcggtgtttcgtgcgatcagtcgaagagaccgaaggtcatgtag

SEQ ID NO: 327 - protein, 182 aa, Pseudomonas aeruginosa
GPDLPVRWRSAGPVPGRWSGGTGGTDGGCVAPAPRSAVAVQRARSPWSWRRCAWLQYQRCSWARALACGTWTPQWAQRTIGDALGSSCGRCCWRGVGRVKRRQSQNAMAIRAIQNRRRKRPMVISEAGESCSLAKPPARSQTGRSRLCGVWRWERHGGGQKEGRPAPPFGVSCDQSKRPKVM

SEQ ID NO: 328 - DNA, 402 bp, Pseudomonas aeruginosa
tcgcacgaaacaccgaagggaggcgcaggcctcccttctttttgcccgccgccatgcctctcccagcgccaaacgccgcacagcctggaccttcccgtctgggatcgagccggcggcttggctaaactgcagctttctccagcctccgagatcaccatgggccttttccgcctcctgttctggatcgccctgatcgccatcgcgttctggctctggcgtcgctttacccgtcccactccgcgccagcagcaacgtccgcaggacgagccgagcgcatcgccgatggtccgctgcgcccattgcggcgtccacgtgccgcaggccaacgccctcgcccacgaacaacgctggtattgcagccaggcgcacctgcgccaggaccagggcgaccgtgcgcgctga

SEQ ID NO: 329 - protein, 133 aa, Pseudomonas aeruginosa
SHETPKGGAGLPSFCPPPCLSQRQTPHSLDLPVWDRAGGLAKLQLSPASEITMGLFRLLFWIALIAIAFWLWRRFTRPTPRQQQRPQDEPSASPMVRCAHCGVHVPQANALAHEQRWYCSQAHLRQDQGDRAR

SEQ ID NO: 330 - DNA, 1791 bp, Pseudomonas aeruginosa
tcgccatcgcgttctggctctggcgtcgctttacccgtcccactccgcgccagcagcaacgtccgcaggacgagccgagcgcatcgccgatggtccgctgcgcccattgcggcgtccacgtgccgcaggccaacgccctcgcccacgaacaacgctggtattgcagccaggcgcacctgcgccaggaccagggcgaccgtgcgcgctgaacggctacggctgagcgaggagcaggggcaacgcatcctccgtctgtaccacctgtaccgcctgaccatcggcctggtactggtcctgctgatctccagcgaactggaagatcaggtcctcaagctcgtccaccctgaactgttccatgtcggcagttggtgctacctggtcttcaacatcctggtcgcgctgttcctgccgccgtcgcggcaattgctgccgatcttcatcctcgcgctcaccgacgtgctgatgctttgcggcctgttctacgcaggtggcggcgtacccagcggcatcggcagcctgctggtggtggcggtggccattgccaacatcctgctgcgcgggcgcatcggcctggtcatcgcggcggcggccagcctcggcctgctctacctgaccttcttcctcagcctgagcagtccggacgccaccaaccactacgtccaggccggcggcctcggcaccctgtgcttcgccgccgcgctggtgatccaggctctggtgcggcgccaggagcagaccgaaacgctggccgaagaacgcgccgagacggtcgccaacctggaggaactcaacgcattgatcctgcagcgcatgcgcaccggcatcctcgtggtcgatagccgtcaggccatcctcctcgccaaccaggccgccctcggcctgctcaggcaggacgacgtgcagggcgccagcctcggccgccacagcccgatgctgatgcactgcatgaagcaatggcgcctgaatcccagcctccgtccgccgacgctcaaggtggtgccggatggcccgacggtgcaacccagctttatcagcctcaaccgcgaagacgaccagcacgtgctgatcttcctcgaagacatttcgcagatcgcccagcaggcgcagcagatgaagctggccggtcttggccgcctgaccgccggcatcgcccatgagatccgcaacccgctgggcgcgatcagccacgccgcccaactgctgcaggagtcagaggaactggatgccccggaccgacgcctgacgcagatcatccaggaccagtcgaagcggatgaacctggtcatcgagaacgtcctgcagctctcccgtcgccgccaggccgaaccgcagcagctcgacctgaaggagtggcttcagcggttcgtcgacgaataccccggcaggctgcgcaacgacagccaactgcacctgcagctcggtgccggcgacatccagacccgcatggacccacaccagttgaaccaggtgctgagcaacctggtgcagaacggtcttcgctacagcgcccaggcgcacgggcgcggccaggtctggctgagcctcgcgcgcgacccggagagcgacctgccggtgctggaagtcatcgacgacggtcccggcgtaccggcggacaaactgaacaacctgttcgaacccttctttactacagaaagcaaaggcaccggcctgggcctctatctctcccgcgaactctgcgagagcaaccaggcacggatcgactaccgcaatcgcgaggaaggcggcggctgcttccgcatcaccttcgcccacccgcgcaaactcagctga

SEQ ID NO: 331 - protein, 596 aa, Pseudomonas aeruginosa
SPSRSGSGVALPVPLRASSNVRRTSRAHRRWSAAPIAASTCRRPTPSPTNNAGIAARRTCARTRATVRAERLRLSEEQGQRILRLYHLYRLTIGLVLVLLISSELEDQVLKLVHPELFHVGSWCYLVFNILVALFLPPSRQLLPIFILALTDVLMLCGLFYAGGGVPSGIGSLLVVAVAIANILLRGRIGLVIAAAASLGLLYLTFFLSLSSPDATNHYVQAGGLGTLCFAAALVIQALVRRQEQTETLAEERAETVANLEELNALILQRMRTGILVVDSRQAILLANQAALGLLRQDDVQGASLGRHSPMLMHCMKQWRLNPSLRPPTLKVVPDGPTVQPSFISLNREDDQHVLIFLEDISQIAQQAQQMKLAGLGRLTAGIAHEIRNPLGAISHAAQLLQESEELDAPDRRLTQIIQDQSKRMNLVIENVLQLSRRRQAEPQQLDLKEWLQRFVDEYPGRLRNDSQLHLQLGAGDIQTRMDPHQLNQVLSNLVQNGLRYSAQAHGRGQVWLSLARDPESDLPVLEVIDDGPGVPADKLNNLFEPFFTTESKGTGLGLYLSRELCESNQARIDYRNREEGGGCFRITFAHPRKLS

SEQ ID NO: 332 - DNA, 996 bp, Pseudomonas aeruginosa
ctcctgcagcagttgggcggcgtggctgatcgcgcccagcgggttgcggatctcatgggcgatgccggcggtcaggcggccaagaccggccagcttcatctgctgcgcctgctgggcgatctgcgaaatgtcttcgaggaagatcagcacgtgctggtcgtcttcgcggttgaggctgataaagctgggttgcaccgtcgggccatccggcaccaccttgagcgtcggcggacggaggctgggattcaggcgccattgcttcatgcagtgcatcagcatcgggctgtggcggccgaggctggcgccctgcacgtcgtcctgcctgagcaggccgagggcggcctggttggcgaggaggatggcctgacggctatcgaccacgaggatgccggtgcgcatgcgctgcaggatcaatgcgttgagttcctccaggttggcgaccgtctcggcgcgttcttcggccagcgtttcggtctgctcctggcgccgcaccagagcctggatcaccagcgcggcggcgaagcacagggtgccgaggccgccggcctggacgtagtggttggtggcgtccggactgctcaggctgaggaagaaggtcaggtagagcaggccgaggctggccgccgccgcgatgaccaggccgatgcgcccgcgcagcaggatgttggcaatggccaccgccaccaccagcaggctgccgatgccgctgggtacgccgccacctgcgtagaacaggccgcaaagcatcagcacgtcggtgagcgcgaggatgaagatcggcagcaattgccgcgacggcggcaggaacagcgcgaccaggatgttgaagaccaggtagcaccaactgccgacatggaacagttcagggtggacgagcttgaggacctgatcttccagttcgctggagatcagcaggaccagtaccaggccgatggtcaggcggtacaggtggtacagacggaggatgcgttgcccctgctcctcgctcagccgtag

SEQ ID NO: 333 - protein, 331 aa, Pseudomonas aeruginosa
LLQQLGGVADRAQRVADLMGDAGGQAAKTGQLHLLRLLGDLRNVFEEDQHVLVVFAVEADKAGLHRRAIRHHLERRRTEAGIQAPLLHAVHQHRAVAAEAGALHVVLPEQAEGGLVGEEDGLTAIDHEDAGAHALQDQCVEFLQVGDRLGAFFGQRFGLLLAPHQSLDHQRGGEAQGAEAAGLDVVVGGVRTAQAEEEGQVEQAEAGRRRDDQADAPAQQDVGNGHRHHQQAADAAGYAATCVEQAAKHQHVGEREDEDRQQLPRRRQEQRDQDVEDQVAPTADMEQFRVDELEDLIFQFAGDQQDQYQADGQAVQVVQTEDALPLLLAQP

SEQ ID NO: 334 - DNA, 492 bp, Pseudomonas aeruginosa
actgttccatgtcggcagttggtgctacctggtcttcaacatcctggtcgcgctgttcctgccgccgtcgcggcaattgctgccgatcttcatcctcgcgctcaccgacgtgctgatgctttgcggcctgttctacgcaggtggcggcgtacccagcggcatcggcagcctgctggtggtggcggtggccattgccaacatcctgctgcgcgggcgcatcggcctggtcatcgcggcggcggccagcctcggcctgctctacctgaccttcttcctcagcctgagcagtccggacgccaccaaccactacgtccaggccggcggcctcggcaccctgtgcttcgccgccgcgctggtgatccaggctctggtgcggcgccaggagcagaccgaaacgctggccgaagaacgcgccgagacggtcgccaacctggaggaactcaacgcattgatcctgcagcgcatgcgcaccggcatcctcgtggtcgatag

SEQ ID NO: 335 - protein, 163 aa, Pseudomonas aeruginosa
TVPCRQLVLPGLQHPGRAVPAAVAAIAADLHPRAHRRADALRPVLRRWRRTQRHRQPAGGGGGHCQHPAARAHRPGHRGGGQPRPALPDLLPQPEQSGRHQPLRPGRRPRHPVLRRRAGDPGSGAAPGADRNAGRRTRRDGRQPGGTQRIDPAAHAHRHPRGR

SEQ ID NO: 336 - DNA, 318 bp, Pseudomonas aeruginosa
ccgtcaggccatcctcctcgccaaccaggccgccctcggcctgctcaggcaggacgacgtgcagggcgccagcctcggccgccacagcccgatgctgatgcactgcatgaagcaatggcgcctgaatcccagcctccgtccgccgacgctcaaggtggtgccggatggcccgacggtgcaacccagctttatcagcctcaaccgcgaagacgaccagcacgtgctgatcttcctcgaagacatttcgcagatcgcccagcaggcgcagcagatgaagctggccggtcttggccgcctgaccgccggcatcgcccatga

SEQ ID NO: 337 - protein, 105 aa, Pseudomonas aeruginosa
PSGHPPRQPGRPRPAQAGRRAGRQPRPPQPDADALHEAMAPESQPPSADAQGGAGWPDGATQLYQPQPRRRPARADLPRRHFADRPAGAADEAGRSWPPDRRHRP

SEQ ID NO: 338 - DNA, 513 bp, Pseudomonas aeruginosa
agccactccttcaggtcgagctgctgcggttcggcctggcggcgacgggagagctgcaggacgttctcgatgaccaggttcatccgcttcgactggtcctggatgatctgcgtcaggcgtcggtccggggcatccagttcctctgactcctgcagcagttgggcggcgtggctgatcgcgcccagcgggttgcggatctcatgggcgatgccggcggtcaggcggccaagaccggccagcttcatctgctgcgcctgctgggcgatctgcgaaatgtcttcgaggaagatcagcacgtgctggtcgtcttcgcggttgaggctgataaagctgggttgcaccgtcgggccatccggcaccaccttgagcgtcggcggacggaggctgggattcaggcgccattgcttcatgcagtgcatcagcatcgggctgtggcggccgaggctggcgccctgcacgtcgtcctgcctgagcaggccgagggcggcctggttggcgaggaggatggcctga

SEQ ID NO: 339 - protein, 170 aa, Pseudomonas aeruginosa
SHSFRSSCCGSAWRRRESCRTFSMTRFIRFDWSWMICVRRRSGASSSSDSCSSWAAWLIAPSGLRISWAMPAVRRPRPASFICCACWAICEMSSRKISTCWSSSRLRLIKLGCTVGPSGTTLSVGGRRLGFRRHCFMQCISIGLWRPRLAPCTSSCLSRPRAAWLARRMA

SEQ ID NO: 340 - DNA, 888 bp, Pseudomonas aeruginosa
gatccgcaacccgctgggcgcgatcagccacgccgcccaactgctgcaggagtcagaggaactggatgccccggaccgacgcctgacgcagatcatccaggaccagtcgaagcggatgaacctggtcatcgagaacgtcctgcagctctcccgtcgccgccaggccgaaccgcagcagctcgacctgaaggagtggcttcagcggttcgtcgacgaataccccggcaggctgcgcaacgacagccaactgcacctgcagctcggtgccggcgacatccagacccgcatggacccacaccagttgaaccaggtgctgagcaacctggtgcagaacggtcttcgctacagcgcccaggcgcacgggcgcggccaggtctggctgagcctcgcgcgcgacccggagagcgacctgccggtgctggaagtcatcgacgacggtcccggcgtaccggcggacaaactgaacaacctgttcgaacccttctttactacagaaagcaaaggcaccggcctgggcctctatctctcccgcgaactctgcgagagcaaccaggcacggatcgactaccgcaatcgcgaggaaggcggcggctgcttccgcatcaccttcgcccacccgcgcaaactcagctgacggaagccgcacgcatgagccgacaaaaagccctgatcgtcgacgatgaaccggatatccgcgaactgctggaaatcactctcggccgcatgaagctggacacccgcagcgcccgcaacgtcaaggaagccgcgagttgctggcccgcgagccgttcgacctgtgcctcaccgacatgcgcctgccggacggcagcggcctcgatctggtccagtacatccagcagcgccatccacagaccccggtggccatga

SEQ ID NO: 341 - protein, 295 aa, Pseudomonas aeruginosa
DPQPAGRDQPRRPTAAGVRGTGCPGPTPDADHPGPVEADEPGHRERPAALPSPPGRTAAARPEGVASAVRRRIPRQAAQRQPTAPAARCRRHPDPHGPTPVEPGAEQPGAERSSLQRPGARARPGLAEPRARPGERPAGAGSHRRRSRRTGGQTEQPVRTLLYYRKQRHRPGPLSLPRTLREQPGTDRLPQSRGRRRLLPHHLRPPAQTQLTEAARMSRQKALIVDDEPDIRELLEITLGRMKLDTRSARNVKEAASCWPASRSTCASPTCACRTAAASIWSSTSSSAIHRPRWP

SEQ ID NO: 342 - DNA, 657 bp, Pseudomonas aeruginosa
tttccagcagttcgcggatatccggttcatcgtcgacgatcagggctttttgtcggctcatgcgtgcggcttccgtcagctgagtttgcgcgggtgggcgaaggtgatgcggaagcagccgccgccttcctcgcgattgcggtagtcgatccgtgcctggttgctctcgcagagttcgcgggagagatagaggcccaggccggtgcctttgctttctgtagtaaagaagggttcgaacaggttgttcagtttgtccgccggtacgccgggaccgtcgtcgatgacttccagcaccggcaggtcgctctccgggtcgcgcgcgaggctcagccagacctggccgcgcccgtgcgcctgggcgctgtagcgaagaccgttctgcaccaggttgctcagcacctggttcaactggtgtgggtccatgcgggtctggatgtcgccggcaccgagctgcaggtgcagttggctgtcgttgcgcagcctgccggggtattcgtcgacgaaccgctgaagccactccttcaggtcgagctgctgcggttcggcctggcggcgacgggagagctgcaggacgttctcgatgaccaggttcatccgcttcgactggtcctggatgatctgcgtcaggcgtcggtccggggcatccagttcctctga

SEQ ID NO: 343 - protein, 218 aa, Pseudomonas aeruginosa
FPAVRGYPVHRRRSGLFVGSCVRLPSAEFARVGEGDAEAAAAFLAIAVVDPCLVALAEFAGEIEAQAGAFAFCSKEGFEQVVQFVRRYAGTVVDDFQHRQVALRVAREAQPDLAAPVRLGAVAKTVLHQVAQHLVQLVWVHAGLDVAGTELQVQLAVVAQPAGVFVDEPLKPLLQVELLRFGLAATGELQDVLDDQVHPLRLVLDDLRQASVRGIQFL

SEQ ID NO: 344 - DNA, 300 bp, Pseudomonas aeruginosa
cttccagcaccggcaggtcgctctccgggtcgcgcgcgaggctcagccagacctggccgcgcccgtgcgcctgggcgctgtagcgaagaccgttctgcaccaggttgctcagcacctggttcaactggtgtgggtccatgcgggtctggatgtcgccggcaccgagctgcaggtgcagttggctgtcgttgcgcagcctgccggggtattcgtcgacgaaccgctgaagccactccttcaggtcgagctgctgcggttcggcctggcggcgacgggagagctgcaggacgttctcgatga

SEQ ID NO: 345 - protein, 99 aa, Pseudomonas aeruginosa
LPAPAGRSPGRARGSARPGRARAPGRCSEDRSAPGCSAPGSTGVGPCGSGCRRHRAAGAVGCRCAACRGIRRRTAEATPSGRAAAVRPGGDGRAAGRSR

SEQ ID NO: 346 - DNA, 375 bp, Pseudomonas aeruginosa
ggcggttgccaccagctcccgcaagcgaccgaggtcgaccggtttggtgaggaagtcgaaggcaccggccttgagcgcctggatcgcggtgtccaggctgccgtacgcggtgatcatggccaccggggtctgtggatggcgctgctggatgtactggaccagatcgaggccgctgccgtccggcaggcgcatgtcggtgaggcacaggtcgaacggctcgcgggccagcaactcgcggcttccttgacgttgcgggcgctgcgggtgtccagcttcatgcggccgagagtgatttccagcagttcgcggatatccggttcatcgtcgacgatcagggctttttgtcggctcatgcgtgcggcttccgtcagctga

SEQ ID NO: 347 - protein, 124 aa, Pseudomonas aeruginosa
GGCHQLPQATEVDRFGEEVEGTGLERLDRGVQAAVRGDHGHRGLWMALLDVLDQIEAAAVRQAHVGEAQVERLAGQQLAASLTLRALRVSSFMRPRVISSSSRISGSSSTIRAFCRLMRAASVS

SEQ ID NO: 348 - DNA, 1302 bp, Pseudomonas aeruginosa
accggatatccgcgaactgctggaaatcactctcggccgcatgaagctggacacccgcagcgcccgcaacgtcaaggaagccgcgagttgctggcccgcgagccgttcgacctgtgcctcaccgacatgcgcctgccggacggcagcggcctcgatctggtccagtacatccagcagcgccatccacagaccccggtggccatgatcaccgcgtacggcagcctggacaccgcgatccaggcgctcaaggccggtgccttcgacttcctcaccaaaccggtcgacctcggtcgcttgcgggagctggtggcaaccgccctacgcttgcgcaacccggaagccgaggaagcgccggtggacaaccgcctgctcggcgagtcgccgccgatgcgcgccctgcgcaaccagatcggcaagctggcgcgcagccaggcgccggtctacatcagtggcgagtccggcagcggcaaggaactggtggcgcgcctgatccacgagcaggggccacgtatcgagcggccgttcgtgccggtgaactgcggcgcgattccctccgagctgatggaaagcgagttcttcggccacaagaaaggcagcttcactggcgctatcgaagacaagcagggcctgttccaggccgccagcggtggcaccctgttcctcgacgaagtcgccgacctgccgatggccatgcaggtcaaactgctccgggcgatccaggaaaaggccgtgcgcgcggtcggcggccagcaggaggtcgccgtcgcacgtgcgcatcctctgcgccacccacaaggacctcgccgccgaagtcggcgccgggcgcttccgccaggacctctactaccgcctcaacgtcatcgagctgcgcgtacaccgctgcgcgaacgccgcgaggacatcccgctgctcgccgaacgcatcctcaagcgcctggccggcgacaccggcctgccggccgccaggctgaccggcgacgcacaggagaagctgaagaactaccgcttcccgggcaacgtccgcgagctggaaaacatgctggagcgcgcctataccctgtgcgaagacgaccagatccagcctcacgacctgcgcctggccgatgcgccgggtgccagccaggaaggcgccgcgagcctgagcgaaatcgacaacctcgaggactacctggaagacatcgagcgcaagctgatcatgcaggcactcgaggagacccgctggaaccgcaccgccgcggcccagcgcctgggcctgacgttccgctcgatgcgctaccgcctgaaaaagctgggcatcgactga

SEQ ID NO: 349 - protein, 433 aa, Pseudomonas aeruginosa
TGYPRTAGNHSRPHEAGHPQRPQRQGSRELLAREPFDLCLTDMRLPDGSGLDLVQYIQQRHPQTPVAMITAYGSLDTAIQALKAGAFDFLTKPVDLGRLRELVATALRLRNPEAEEAPVDNRLLGESPPMRALRNQIGKLARSQAPVYISGESGSGKELVARLIHEQGPRIERPFVPVNCGAIPSELMESEFFGHKKGSFTGAIEDKQGLFQAASGGTLFLDEVADLPMAMQVKLLRAIQEKAVRAVGGQQEVAVARAHPLRHPQGPRRRSRRRALPPGPLLPPQRHRAARTPLRERREDIPLLAERILKRLAGDTGLPAARLTGDAQEKLKNYRFPGNVRELENMLERAYTLCEDDQIQPHDLRLADAPGASQEGAASLSEIDNLEDYLEDIERKLIMQALEETRWNRTAAAQRLGLTFRSMRYRLKKLGID

SEQ ID NO: 350 - DNA, 1344 bp, Pseudomonas aeruginosa
agctggacacccgcagcgcccgcaacgtcaaggaagccgcgagttgctggcccgcgagccgttcgacctgtgcctcaccgacatgcgcctgccggacggcagcggcctcgatctggtccagtacatccagcagcgccatccacagaccccggtggccatgatcaccgcgtacggcagcctggacaccgcgatccaggcgctcaaggccggtgccttcgacttcctcaccaaaccggtcgacctcggtcgcttgcgggagctggtggcaaccgccctacgcttgcgcaacccggaagccgaggaagcgccggtggacaaccgcctgctcggcgagtcgccgccgatgcgcgccctgcgcaaccagatcggcaagctggcgcgcagccaggcgccggtctacatcagtggcgagtccggcagcggcaaggaactggtggcgcgcctgatccacgagcaggggccacgtatcgagcggccgttcgtgccggtgaactgcggcgcgattccctccgagctgatggaaagcgagttcttcggccacaagaaaggcagcttcactggcgctatcgaagacaagcagggcctgttccaggccgccagcggtggcaccctgttcctcgacgaagtcgccgacctgccgatggccatgcaggtcaaactgctccgggcgatccaggaaaaggccgtgcgcgcggtcggcggccagcaggaggtcgccgtcgcacgtgcgcatcctctgcgccacccacaaggacctcgccgccgaagtcggcgccgggcgcttccgccaggacctctactaccgcctcaacgtcatcgagctgcgcgtacaccgctgcgcgaacgccgcgaggacatcccgctgctcgccgaacgcatcctcaagcgcctggccggcgacaccggcctgccggccgccaggctgaccggcgacgcacaggagaagctgaagaactaccgcttcccgggcaacgtccgcgagctggaaaacatgctggagcgcgcctataccctgtgcgaagacgaccagatccagcctcacgacctgcgcctggccgatgcgccgggtgccagccaggaaggcgccgcgagcctgagcgaaatcgacaacctcgaggactacctggaagacatcgagcgcaagctgatcatgcaggcactcgaggagacccgctggaaccgcaccgccgcggcccagcgcctgggcctgacgttccgctcgatgcgctaccgcctgaaaaagctgggcatcgactgaaagtgaaaaggcctgtccgaagacaggccttttggttttcgctcctcagaggcgaccagccggggcgtagggggccgggtcgatga

SEQ ID NO: 351 - protein, 447 aa, Pseudomonas aeruginosa
SWTPAAPATSRKPRVAGPRAVRPVPHRHAPAGRQRPRSGPVHPAAPSTDPGGHDHRVRQPGHRDPGAQGRCLRLPHQTGRPRSLAGAGGNRPTLAQPGSRGSAGGQPPARRVAADARPAQPDRQAGAQPGAGLHQWRVRQRQGTGGAPDPRAGATYRAAVRAGELRRDSLRADGKRVLRPQERQLHWRYRRQAGPVPGRQRWHPVPRRSRRPADGHAGQTAPGDPGKGRARGRRPAGGRRRTCASSAPPTRTSPPKSAPGASARTSTTASTSSSCAYTAARTPRGHPAARRTHPQAPGRRHRPAGRQADRRRTGEAEELPLPGQRPRAGKHAGARLYPVRRRPDPASRPAPGRCAGCQPGRRREPERNRQPRGLPGRHRAQADHAGTRGDPLEPHRRGPAPGPDVPLDALPPEKAGHRLKVKRPVRRQAFWFSLLRGDQPGRRGPGR

SEQ ID NO: 352 - DNA, 369 bp, Pseudomonas aeruginosa
accggcgcctggctgcgcgccagcttgccgatctggttgcgcagggcgcgcatcggcggcgactcgccgagcaggcggttgtccaccggcgcttcctcggcttccgggttgcgcaagcgtagggcggttgccaccagctcccgcaagcgaccgaggtcgaccggtttggtgaggaagtcgaaggcaccggccttgagcgcctggatcgcggtgtccaggctgccgtacgcggtgatcatggccaccggggtctgtggatggcgctgctggatgtactggaccagatcgaggccgctgccgtccggcaggcgcatgtcggtgaggcacaggtcgaacggctcgcgggccagcaactcgcggcttccttga

SEQ ID NO: 353 - protein, 122 aa, Pseudomonas aeruginosa
TGAWLRASLPIWLRRARIGGDSPSRRLSTGASSASGLRKRRAVATSSRKRPRSTGLVRKSKAPALSAWIAVSRLPYAVIMATGVCGWRCWMYWTRSRPLPSGRRMSVRHRSNGSRASNSRLP

SEQ ID NO: 354 - DNA, 522 bp, Pseudomonas aeruginosa
aggtcctggcggaagcgcccggcgccgacttcggcggcgaggtccttgtgggtggcgcagaggatgcgcacgtgcgacggcgacctcctgctggccgccgaccgcgcgcacggccttttcctggatcgcccggagcagtttgacctgcatggccatcggcaggtcggcgacttcgtcgaggaacagggtgccaccgctggcggcctggaacaggccctgcttgtcttcgatagcgccagtgaagctgcctttcttgtggccgaagaactcgctttccatcagctcggagggaatcgcgccgcagttcaccggcacgaacggccgctcgatacgtggcccctgctcgtggatcaggcgcgccaccagttccttgccgctgccggactcgccactgatgtagaccggcgcctggctgcgcgccagcttgccgatctggttgcgcagggcgcgcatcggcggcgactcgccgagcaggcggttgtccaccggcgcttcctcggcttccgggttgcgcaagcgtag

SEQ ID NO: 355 - protein, 173 aa, Pseudomonas aeruginosa
RSWRKRPAPTSAARSLWVAQRMRTCDGDLLLAADRAHGLFLDRPEQFDLHGHRQVGDFVEEQGATAGGLEQALLVFDSASEAAFLVAEELAFHQLGGNRAAVHRHERPLDTWPLLVDQARHQFLAAAGLATDVDRRLAARQLADLVAQGAHRRRLAEQAVVHRRFLGFRVAQA

SEQ ID NO: 356 - DNA, 411 bp, Pseudomonas aeruginosa
ggcggtagtagaggtcctggcggaagcgcccggcgccgacttcggcggcgaggtccttgtgggtggcgcagaggatgcgcacgtgcgacggcgacctcctgctggccgccgaccgcgcgcacggccttttcctggatcgcccggagcagtttgacctgcatggccatcggcaggtcggcgacttcgtcgaggaacagggtgccaccgctggcggcctggaacaggccctgcttgtcttcgatagcgccagtgaagctgcctttcttgtggccgaagaactcgctttccatcagctcggagggaatcgcgccgcagttcaccggcacgaacggccgctcgatacgtggcccctgctcgtggatcaggcgcgccaccagttccttgccgctgccggactcgccactgatgtag

SEQ ID NO: 357 - protein, 136 aa, Pseudomonas aeruginosa
GGSRGPGGSARRRLRRRGPCGWRRGCARATATSCWPPTARTAFSWIARSSLTCMAIGRSATSSRNRVPPLAAWNRPCLSSIAPVKLPFLWPKNSLSISSEGIAPQFTGTNGRSIRGPCSWIRRATSSLPLPDSPLM

SEQ ID NO: 358 - DNA, 408 bp, Pseudomonas aeruginosa
tggaaagcgagttcttcggccacaagaaaggcagcttcactggcgctatcgaagacaagcagggcctgttccaggccgccagcggtggcaccctgttcctcgacgaagtcgccgacctgccgatggccatgcaggtcaaactgctccgggcgatccaggaaaaggccgtgcgcgcggtcggcggccagcaggaggtcgccgtcgcacgtgcgcatcctctgcgccacccacaaggacctcgccgccgaagtcggcgccgggcgcttccgccaggacctctactaccgcctcaacgtcatcgagctgcgcgtacaccgctgcgcgaacgccgcgaggacatcccgctgctcgccgaacgcatcctcaagcgcctggccggcgacaccggcctgccggccgccaggctga

SEQ ID NO: 359 - protein, 135 aa, Pseudomonas aeruginosa
WKASSSATRKAASLALSKTSRACSRPPAVAPCSSTKSPTCRWPCRSNCSGRSRKRPCARSAASRRSPSHVRILCATHKDLAAEVGAGRFRQDLYYRLNVIELRVHRCANAARTSRCSPNASSSAWPATPACRPPG

SEQ ID NO: 360 - DNA, 504 bp, Pseudomonas aeruginosa
ggagcgaaaaccaaaaggcctgtcttcggacaggccttttcactttcagtcgatgcccagctttttcaggcggtagcgcatcgagcggaacgtcaggcccaggcgctgggccgcggcggtgcggttccagcgggtctcctcgagtgcctgcatgatcagcttgcgctcgatgtcttccaggtagtcctcgaggttgtcgatttcgctcaggctcgcggcgccttcctggctggcacccggcgcatcggccaggcgcaggtcgtgaggctggatctggtcgtcttcgcacagggtataggcgcgctccagcatgttttccagctcgcggacgttgcccgggaagcggtagttcttcagcttctcctgtgcgtcgccggtcagcctggcggccggcaggccggtgtcgccggccaggcgcttgaggatgcgttcggcgagcagcgggatgtcctcgcggcgttcgcgcagcggtgtacgcgcagctcgatgacgttgaggcggtag

SEQ ID NO: 361 - protein, 167 aa, Pseudomonas aeruginosa
GAKTKRPVFGQAFSLSVDAQLFQAVAHRAERQAQALGRGGAVPAGLLECLHDQLALDVFQVVLEVVDFAQARGAFLAGTRRIGQAQVVRLDLVVFAQGIGALQHVFQLADVAREAVVLQLLLCVAGQPGGRQAGVAGQALEDAFGEQRDVLAAFAQRCTRSSMTLRR

SEQ ID NO: 362 - DNA, 744 bp, Pseudomonas aeruginosa
acagacggaggtgcgcggctggttgcgcgacggcgatcgagtggtcggcgtggcgacctcgcgtggcgagatccgtggcgacaaggtgctgctggcggcaggcgcctggagcggcgagttgttgaagccgcttggcctggaactgcccgtggtaccggtgaaaggtcagatgatcctctacaagtgcgcggcggatttcctgccgcgcatggtgctggccaaggggcgctacgcgattccgcggcgcgacggccacatcctgatcggcagcaccttggaacattcgggcttcgacaagacgccgaccgacgaggcgctggaaagcctcagggcgtctgcggcagaactgttgccggaactggcggacatgcagccggtggcccactgggcagggttgcgcccgggctctcccgaaggcatcccctatatcggtccggtgcctggcttcgacgggctctggctgaataccgggcactaccgcaacgggctggtcctggcaccggcgtcgtgccgtctgctggcggatctcatgagcgggcgggaaccgatcatcgacccggccccctacgccccggctggtcgcctctgaggagcgaaaaccaaaaggcctgtcttcggacaggccttttcactttcagtcgatgcccagctttttcaggcggtagcgcatcgagcggaacgtcaggcccaggcgctgggccgcggcggtgcggttccagcgggtctcctcgagtgcctgcatga

SEQ ID NO: 363 - protein, 247 aa, Pseudomonas aeruginosa
TDGGARLVARRRSSGRRGDLAWRDPWRQGAAGGRRLERRVVEAAWPGTARGTGERSDDPLQVRGGFPAAHGAGQGALRDSAARRPHPDRQHLGTFGLRQDADRRGAGKPQGVCGRTVAGTGGHAAGGPLGRVAPGLSRRHPLYRSGAWLRRALAEYRALPQRAGPGTGVVPSAGGSHERAGTDHRPGPLRPGWSPLRSENQKACLRTGLFTFSRCPAFSGGSASSGTSGPGAGPRRCGSSGSPRVPA

SEQ ID NO: 364 - DNA, 675 bp, Pseudomonas aeruginosa
aaaggcctgtccgaagacaggccttttggttttcgctcctcagaggcgaccagccggggcgtagggggccgggtcgatgatcggttcccgcccgctcatgagatccgccagcagacggcacgacgccggtgccaggaccagcccgttgcggtagtgcccggtattcagccagagcccgtcgaagccaggcaccggaccgatataggggatgccttcgggagagcccgggcgcaaccctgcccagtgggccaccggctgcatgtccgccagttccggcaacagttctgccgcagacgccctgaggctttccagcgcctcgtcggtcggcgtcttgtcgaagcccgaatgttccaaggtgctgccgatcaggatgtggccgtcgcgccgcggaatcgcgtagcgccccttggccagcaccatgcgcggcaggaaatccgccgcgcacttgtagaggatcatctgacctttcaccggtaccacgggcagttccaggccaagcggcttcaacaactcgccgctccaggcgcctgccgccagcagcaccttgtcgccacggatctcgccacgcgaggtcgccacgccgaccactcgatcgccgtcgcgcaaccagccgcgcacctccgtctgttcatgcaactcgagattggcgaattgttgcagggatgcccgcaatga

SEQ ID NO: 365 - protein, 224 aa, Pseudomonas aeruginosa
KGLSEDRPFGFRSSEATSRGVGGRVDDRFPPAHEIRQQTARRRCQDQPVAVVPGIQPEPVEARHRTDIGDAFGRARAQPCPVGHRLHVRQFRQQFCRRRPEAFQRLVGRRLVEARMFQGAADQDVAVAPRNRVAPLGQHHARQEIRRALVEDHLTFHRYHGQFQAKRLQQLAAPGACRQQHLVATDLATRGRHADHSIAVAQPAAHLRLFMQLEIGELLQGCPQ

SEQ ID NO: 366 - DNA, 1137 bp, Pseudomonas aeruginosa
gtgatatttctctgttcctggcaaatcggtaggagccctgtggtgagtagagatgtagtagtggtaggcgctggcgtcatcggcctgttgaccgcccgggagctggcgctcgccggactgcgggtgaccctggtggagcggggcgagagtgggcgtgaggcatcctgggcgggaggcgggatcgtctcgccgctctatccgtggcgctacagcccggcggtgaccgccctggcgcactggtcgcaggacttctacccggccctggggcagcgtttgctcgacgagaccgggctcgatcccgaggtccataccgttggcctgtactggctggacctggacgaccagaccgaggcactgcagtgggcacgcaaccacacccggccgttgaaggaagtgccgatcgaggaggcctacgcggcggtgcccgggctgggcgcaggcttccagcgggcggtctacatgtcgggcgtggccaatgtgcgcaatcctcgcctggcgcgctcattgcgggcatccctgcaacaattcgccaatctcgagttgcatgaacagacggaggtgcgcggctggttgcgcgacggcgatcgagtggtcggcgtggcgacctcgcgtggcgagatccgtggcgacaaggtgctgctggcggcaggcgcctggagcggcgagttgttgaagccgcttggcctggaactgcccgtggtaccggtgaaaggtcagatgatcctctacaagtgcgcggcggatttcctgccgcgcatggtgctggccaaggggcgctacgcgattccgcggcgcgacggccacatcctgatcggcagcaccttggaacattcgggcttcgacaagacgccgaccgacgaggcgctggaaagcctcagggcgtctgcggcagaactgttgccggaactggcggacatgcagccggtggcccactgggcagggttgcgcccgggctctcccgaaggcatcccctatatcggtccggtgcctggcttcgacgggctctggctgaataccgggcactaccgcaacgggctggtcctggcaccggcgtcgtgccgtctgctggcggatctcatgagcgggcgggaaccgatcatcgacccggccccctacgccccggctggtcgcctctga

SEQ ID NO: 367 - protein, 378 aa, Pseudomonas aeruginosa
VIFLCSWQIGRSPVVSRDVVVVGAGVIGLLTARELALAGLRVTLVERGESGREASWAGGGIVSPLYPWRYSPAVTALAHWSQDFYPALGQRLLDETGLDPEVHTVGLYWLDLDDQTEALQWARNHTRPLKEVPIEEAYAAVPGLGAGFQRAVYMSGVANVRNPRLARSLRASLQQFANLELHEQTEVRGWLRDGDRVVGVATSRGEIRGDKVLLAAGAWSGELLKPLGLELPVVPVKGQMILYKCAADFLPRMVLAKGRYAIPRRDGHILIGSTLEHSGFDKTPTDEALESLRASAAELLPELADMQPVAHWAGLRPGSPEGIPYIGPVPGFDGLWLNTGHYRNGLVLAPASCRLLADLMSGREPIIDPAPYAPAGRL

SEQ ID NO: 368 - DNA, 798 bp, Pseudomonas aeruginosa
ggctttccagcgcctcgtcggtcggcgtcttgtcgaagcccgaatgttccaaggtgctgccgatcaggatgtggccgtcgcgccgcggaatcgcgtagcgccccttggccagcaccatgcgcggcaggaaatccgccgcgcacttgtagaggatcatctgacctttcaccggtaccacgggcagttccaggccaagcggcttcaacaactcgccgctccaggcgcctgccgccagcagcaccttgtcgccacggatctcgccacgcgaggtcgccacgccgaccactcgatcgccgtcgcgcaaccagccgcgcacctccgtctgttcatgcaactcgagattggcgaattgttgcagggatgcccgcaatgagcgcgccaggcgaggattgcgcacattggccacgcccgacatgtagaccgcccgctggaagcctgcgcccagcccgggcaccgccgcgtaggcctcctcgatcggcacttccttcaacggccgggtgtggttgcgtgcccactgcagtgcctcggtctggtcgtccaggtccagccagtacaggccaacggtatggacctcgggatcgagcccggtctcgtcgagcaaacgctgccccagggccgggtagaagtcctgcgaccagtgcgccagggcggtcaccgccgggctgtagcgccacggatagagcggcgagacgatcccgcctcccgcccaggatgcctcacgcccactctcgccccgctccaccagggtcacccgcagtccggcgagcgccagctcccgggcggtcaacaggccgatga

SEQ ID NO: 369 - protein, 265 aa, Pseudomonas aeruginosa
GFPAPRRSASCRSPNVPRCCRSGCGRRAAESRSAPWPAPCAAGNPPRTCRGSSDLSPVPRAVPGQAASTTRRSRRLPPAAPCRHGSRHARSPRRPLDRRRATSRAPPSVHATRDWRIVAGMPAMSAPGEDCAHWPRPTCRPPAGSLRPARAPPRRPPRSALPSTAGCGCVPTAVPRSGRPGPASTGQRYGPRDRARSRRANAAPGPGRSPATSAPGRSPPGCSATDRAARRSRLPPRMPHAHSRPAPPGSPAVRRAPAPGRSTGR

SEQ ID NO: 370 - DNA, 390 bp, Pseudomonas aeruginosa
ggcatcctgggcgggaggcgggatcgtctcgccgctctatccgtggcgctacagcccggcggtgaccgccctggcgcactggtcgcaggacttctacccggccctggggcagcgtttgctcgacgagaccgggctcgatcccgaggtccataccgttggcctgtactggctggacctggacgaccagaccgaggcactgcagtgggcacgcaaccacacccggccgttgaaggaagtgccgatcgaggaggcctacgcggcggtgcccgggctgggcgcaggcttccagcgggcggtctacatgtcgggcgtggccaatgtgcgcaatcctcgcctggcgcgctcattgcgggcatccctgcaacaattcgccaatctcgagttgcatga

SEQ ID NO: 371 - protein, 129 aa, Pseudomonas aeruginosa
GILGGRRDRLAALSVALQPGGDRPGALVAGLLPGPGAAFARRDRARSRGPYRWPVLAGPGRPDRGTAVGTQPHPAVEGSADRGGLRGGARAGRRLPAGGLHVGRGQCAQSSPGALIAGIPATIRQSRVA

SEQ ID NO: 372 - DNA, 603 bp, Pseudomonas aeruginosa
gcgcgccaggcgaggattgcgcacattggccacgcccgacatgtagaccgcccgctggaagcctgcgcccagcccgggcaccgccgcgtaggcctcctcgatcggcacttccttcaacggccgggtgtggttgcgtgcccactgcagtgcctcggtctggtcgtccaggtccagccagtacaggccaacggtatggacctcgggatcgagcccggtctcgtcgagcaaacgctgccccagggccgggtagaagtcctgcgaccagtgcgccagggcggtcaccgccgggctgtagcgccacggatagagcggcgagacgatcccgcctcccgcccaggatgcctcacgcccactctcgccccgctccaccagggtcacccgcagtccggcgagcgccagctcccgggcggtcaacaggccgatgacgccagcgcctaccactactacatctctactcaccacagggctcctaccgatttgccaggaacagagaaatatcactcaaagggatcagatgctgacgaattgcctgcttcaacgaactcagtcgaatctagtcccggtgaaaagcccatcatacccgcagaggtattcatcccatga

SEQ ID NO: 373 - protein, 200 aa, Pseudomonas aeruginosa
ARQARIAHIGHARHVDRPLEACAQPGHRRVGLLDRHFLQRPGVVACPLQCLGLVVQVQPVQANGMDLGIEPGLVEQTLPQGRVEVLRPVRQGGHRRAVAPRIERRDDPASRPGCLTPTLAPLHQGHPQSGERQLPGGQQADDASAYHYYISTHHRAPTDLPGTEKYHSKGSDADELPASTNSVESSPGEKPIIPAEVFIP

SEQ ID NO: 374 - DNA, 405 bp, Pseudomonas aeruginosa
agcggcgagacgatcccgcctcccgcccaggatgcctcacgcccactctcgccccgctccaccagggtcacccgcagtccggcgagcgccagctcccgggcggtcaacaggccgatgacgccagcgcctaccactactacatctctactcaccacagggctcctaccgatttgccaggaacagagaaatatcactcaaagggatcagatgctgacgaattgcctgcttcaacgaactcagtcgaatctagtcccggtgaaaagcccatcatacccgcagaggtattcatcccatgaaatcgagtggtttgaatttggtggaactatcgatagtcctatcgatccttgcgataggcgtgacaattgcgctgcccaccctccccgacagaatgaagcgggacattag

SEQ ID NO: 375 - protein, 134 aa, Pseudomonas aeruginosa
SGETIPPPAQDASRPLSPRSTRVTRSPASASSRAVNRPMTPAPTTTTSLLTTGLLPICQEQRNITQRDQMLTNCLLQRTQSNLVPVKSPSYPQRYSSHEIEWFEFGGTIDSPIDPCDRRDNCAAHPPRQNEAGH

SEQ ID NO: 376 - DNA, 534 bp, Pseudomonas aeruginosa
aaagcccatcatacccgcagaggtattcatcccatgaaatcgagtggtttgaatttggtggaactatcgatagtcctatcgatccttgcgataggcgtgacaattgcgctgcccaccctccccgacagaatgaagcgggacattagccgtgatattggtgacagcctgactagtcatgtgatggctgcgcgggctagcagcatacagaacggcgtgatcatcgaggtgtgcggtagcggtgacggcagtacctgcagcgaggaatggcatctcggctggttcagccgtaacgacaggagccaacagatactggcccggcatgaaaatacgagtcgcaccgatattcattggcggggcttcgacaagcgactgcgctacctgcctaatggcaccagccctacaggtaacgggcgtttcttcgaatgtaaggacgatcgcatcgagtggcaattggtgctcaatcggcaaggccgcctcagggtggcgggaaagagcgaaaataaaaagctctcttacctgtgctccaggcggtga

SEQ ID NO: 377 - protein, 177 aa, Pseudomonas aeruginosa
KAHHTRRGIHPMKSSGLNLVELSIVLSILAIGVTIALPTLPDRMKRDISRDIGDSLTSHVMAARASSIQNGVIIEVCGSGDGSTCSEEWHLGWFSRNDRSQQILARHENTSRTDIHWRGFDKRLRYLPNGTSPTGNGRFFECKDDRIEWQLVLNRQGRLRVAGKSENKKLSYLCSRR

SEQ ID NO: 378 - DNA, 540 bp, Pseudomonas aeruginosa
tggagagcgcattgtccctgtagcagagacagccggagcggagagtgggatgactggcaaacggtatgtgaaacagttctctcaccgcctggagcacaggtaagagagctttttattttcgctctttcccgccaccctgaggcggccttgccgattgagcaccaattgccactcgatgcgatcgtccttacattcgaagaaacgcccgttacctgtagggctggtgccattaggcaggtagcgcagtcgcttgtcgaagccccgccaatgaatatcggtgcgactcgtattttcatgccgggccagtatctgttggctcctgtcgttacggctgaaccagccgagatgccattcctcgctgcaggtactgccgtcaccgctaccgcacacctcgatgatcacgccgttctgtatgctgctagcccgcgcagccatcacatgactagtcaggctgtcaccaatatcacggctaatgtcccgcttcattctgtcggggagggtgggcagcgcaattgtcacgcctatcgcaaggatcgatag

SEQ ID NO: 379 - protein, 179 aa, Pseudomonas aeruginosa
WRAHCPCSRDSRSGEWDDWQTVCETVLSPPGAQVRELFIFALSRHPEAALPIEHQLPLDAIVLTFEETPVTCRAGAIRQVAQSLVEAPPMNIGATRIFMPGQYLLAPVVTAEPAEMPFLAAGTAVTATAHLDDHAVLYAASPRSHHMTSQAVTNITANVPLHSVGEGGQRNCHAYRKDR

SEQ ID NO: 380 - DNA, 402 bp, Pseudomonas aeruginosa
tcatcgaggtgtgcggtagcggtgacggcagtacctgcagcgaggaatggcatctcggctggttcagccgtaacgacaggagccaacagatactggcccggcatgaaaatacgagtcgcaccgatattcattggcggggcttcgacaagcgactgcgctacctgcctaatggcaccagccctacaggtaacgggcgtttcttcgaatgtaaggacgatcgcatcgagtggcaattggtgctcaatcggcaaggccgcctcagggtggcgggaaagagcgaaaataaaaagctctcttacctgtgctccaggcggtgagagaactgtttcacataccgtttgccagtcatcccactctccgctccggctgtctctgctacagggacaatgcgctctccactag

SEQ ID NO: 381 - protein, 133 aa, Pseudomonas aeruginosa
SSRCAVAVTAVPAARNGISAGSAVTTGANRYWPGMKIRVAPIFIGGASTSDCATCLMAPALQVTGVSSNVRTIASSGNWCSIGKAASGWRERAKIKSSLTCAPGGERTVSHTVCQSSHSPLRLSLLQGQCALH

SEQ ID NO: 382 - DNA, 642 bp, Pseudomonas aeruginosa
aaagctctcttacctgtgctccaggcggtgagagaactgtttcacataccgtttgccagtcatcccactctccgctccggctgtctctgctacagggacaatgcgctctccactaggcaagattatctggcccttttccttgtggagtactgcatgcgctctatttgtcgcagcgccggcttttccctgatcgagttgatgatggtgttggttctggtcgccatattcgccagcattgccgtacccagtttcaacgccttgatcgagcgcaaccgaatccagactgccagcgaggaactctacagcctgcttcagtacgctcgcagcgaagctgtaaaccgtcatgccaatgtgagcatcagggcgacgcagaacaatgactgggcaaaaggcctggaaatcatcagcggcgcgaccaccgtgcaaaagcaccaaggtttccagcaggtctcgctatccgccagcagtgcgactgcggagctgaccttcaacgctaccggcacacttagcaaccaggctgcaaacattgacataaaggtctgcttcgccggtgacaaaagtacaggacgtctgcttaccgttcagcccagtggacgcgtgatcctgtacccatcttcaaagcaaccggacagctgtaactga

SEQ ID NO: 383 - protein, 213 aa, Pseudomonas aeruginosa
KALLPVLQAVRELFHIPFASHPTLRSGCLCYRDNALSTRQDYLALFLVEYCMRSICRSAGFSLIELMMVLVLVAIFASIAVPSFNALIERNRIQTASEELYSLLQYARSEAVNRHANVSIRATQNNDWAKGLEIISGATTVQKHQGFQQVSLSASSATAELTFNATGTLSNQAANIDIKVCFAGDKSTGRLLTVQPSGRVILYPSSKQPDSCN

SEQ ID NO: 384 - DNA, 444 bp, Pseudomonas aeruginosa
cgagacctgctggaaaccttggtgcttttgcacggtggtcgcgccgctgatgatttccaggccttttgcccagtcattgttctgcgtcgccctgatgctcacattggcatgacggtttacagcttcgctgcgagcgtactgaagcaggctgtagagttcctcgctggcagtctggattcggttgcgctcgatcaaggcgttgaaactgggtacggcaatgctggcgaatatggcgaccagaaccaacaccatcatcaactcgatcagggaaaagccggcgctgcgacaaatagagcgcatgcagtactccacaaggaaaagggccagataatcttgcctagtggagagcgcattgtccctgtagcagagacagccggagcggagagtgggatgactggcaaacggtatgtgaaacagttctctcaccgcctggagcacaggtaa

SEQ ID NO: 385 - protein, 147 aa, Pseudomonas aeruginosa
RDLLETLVLLHGGRAADDFQAFCPVIVLRRPDAHIGMTVYSFAASVLKQAVEFLAGSLDSVALDQGVETGYGNAGEYGDQNQHHHQLDQGKAGAATNRAHAVLHKEKGQIILPSGERIVPVAETAGAESGMTGKRYVKQFSHRLEHR

SEQ ID NO: 386 - DNA, 534 bp, Pseudomonas aeruginosa
ggaaagcccatgtctcgagaaacgggtttcagcatgatcgaagtactggttgctctggtgctgatcagcattggcgtactgggcatggttgccatgcaagggcgcacgatccagtacacgcaggagtcggtacaacgcaatgccgcagcaatgcttgctagcgacctgatggaaataatgcgtgcggacccagatgccgtactcaatctacgcgcccaactacgcgaagactcggtctactacaaggccaagggcagcgactttcccgcagccccagcgcgctgcgcgccattgccagcagatgctaaggaacgtctcggctgctgggcccaacaggcctcgaaagacttgccgggagcctccgcactcttgaatagccaattctacatttgtcgcagcccaaccccgggtacctgcgacaacaccaaaggctcggccatcgaaatccaggttgcctggcgagccatggatggagcgtgtttcaacgcctctgactccaccttgtgcacctacagcgtccgctccgaattgtga

SEQ ID NO: 387 - protein, 177 aa, Pseudomonas aeruginosa
GKPMSRETGFSMIEVLVALVLISIGVLGMVAMQGRTIQYTQESVQRNAAAMLASDLMEIMRADPDAVLNLRAQLREDSVYYKAKGSDFPAAPARCAPLPADAKERLGCWAQQASKDLPGASALLNSQFYICRSPTPGTCDNTKGSAIEIQVAWRAMDGACFNASDSTLCTYSVRSEL

SEQ ID NO: 388 - DNA, 330 bp, Pseudomonas aeruginosa
agagcatgcttgttctcacaattcggagcggacgctgtaggtgcacaaggtggagtcagaggcgttgaaacacgctccatccatggctcgccaggcaacctggatttcgatggccgagcctttggtgttgtcgcaggtacccggggttgggctgcgacaaatgtagaattggctattcaagagtgcggaggctcccggcaagtctttcgaggcctgttgggcccagcagccgagacgttccttagcatctgctggcaatggcgcgcagcgcgctggggctgcgggaaagtcgctgcccttggccttgtagtagaccgagtcttcgcgtag

SEQ ID NO: 389 - protein, 109 aa, Pseudomonas aeruginosa
RACLFSQFGADAVGAQGGVRGVETRSIHGSPGNLDFDGRAFGVVAGTRGWAATNVELAIQECGGSRQVFRGLLGPAAETFLSICWQWRAARWGCGKVAALGLVVDRVFA

SEQ ID NO: 390 - DNA, 327 bp, Pseudomonas aeruginosa
atagccaattctacatttgtcgcagcccaaccccgggtacctgcgacaacaccaaaggctcggccatcgaaatccaggttgcctggcgagccatggatggagcgtgtttcaacgcctctgactccaccttgtgcacctacagcgtccgctccgaattgtgagaacaagcatgctcttcagcaaaatgcagaaaggcctatcgatggtagaactgctcgtggcactcgctataagcagcttcctgatcctggggatcagccagatctacatcgacaacaaacgcaactatcttttccagcaaggccaggccggcaaccaggaaaatag

SEQ ID NO: 391 - protein, 108 aa, Pseudomonas aeruginosa
IANSTFVAAQPRVPATTPKARPSKSRLPGEPWMERVSTPLTPPCAPTASAPNCENKHALQQNAERPIDGRTARGTRYKQLPDPGDQPDLHRQQTQLSFPARPGRQPGK

SEQ ID NO: 392 - DNA, 864 bp, Pseudomonas aeruginosa
ctccaccttgtgcacctacagcgtccgctccgaattgtgagaacaagcatgctcttcagcaaaatgcagaaaggcctatcgatggtagaactgctcgtggcactcgctataagcagcttcctgatcctggggatcagccagatctacatcgacaacaaacgcaactatcttttccagcaaggccaggccggcaaccaggaaaatagccgcttcgttcttatgctgctgcagcaacaactggataagacagcctatcgtcgccttcacgacgacaacatggagaatgctttcaaatccgcgacattcaatggctgtcgtgcatttgtggctggcgagactatcgctgcggcaactgccctcaaggcgggtgagtacggtgtctgcttgcgctatcaacccgcctacaaaggggagcatgattgcctcggtaatgaaattaccggagttccggaaaagcccttcacaaatactccccctgtcgtcgttcgcctggtctacctaccgagcgccggtaccctgagttgcagtcgtcccgatatcgcccagtcgaaatcgggagaattggtcagtggtctcacagacttccgcttggaagcgggggtcgggccagcagatcgtagcgaacgcaaagtatccagcttcgtcgcactacaggatgtcgccggtcgtcctatccgagcattgcgcttctcaatcctggcaggcagcgacaatacaagcctgcgcacaggagatgatagccaggcacgcgatcgctggatcgtcctttatcccgagagcaaaagcgccatcgaggccgcagacaaaggccagatttaccaaatagcgcgtggtaaccaaaccatcaggaatctcatgccatga

SEQ ID NO: 393 - protein, 287 aa, Pseudomonas aeruginosa
LHLVHLQRPLRIVRTSMLFSKMQKGLSMVELLVALAISSFLILGISQIYIDNKRNYLFQQGQAGNQENSRFVLMLLQQQLDKTAYRRLHDDNMENAFKSATFNGCRAFVAGETIAAATALKAGEYGVCLRYQPAYKGEHDCLGNEITGVPEKPFTNTPPVVVRLVYLPSAGTLSCSRPDIAQSKSGELVSGLTDFRLEAGVGPADRSERKVSSFVALQDVAGRPIRALRFSILAGSDNTSLRTGDDSQARDRWIVLYPESKSAIEAADKGQIYQIARGNQTIRNLMP

SEQ ID NO: 394 - DNA, 423 bp, Pseudomonas aeruginosa
gtagaccaggcgaacgacgacagggggagtatttgtgaagggcttttccggaactccggtaatttcattaccgaggcaatcatgctcccctttgtaggcgggttgatagcgcaagcagacaccgtactcacccgccttgagggcagttgccgcagcgatagtctcgccagccacaaatgcacgacagccattgaatgtcgcggatttgaaagcattctccatgttgtcgtcgtgaaggcgacgataggctgtcttatccagttgttgctgcagcagcataagaacgaagcggctattttcctggttgccggcctggccttgctggaaaagatagttgcgtttgttgtcgatgtagatctggctgatccccaggatcaggaagctgcttatagcgagtgccacgagcagttctaccatcgatag

SEQ ID NO: 395 - protein, 140 aa, Pseudomonas aeruginosa
VDQANDDRGSICEGLFRNSGNFITEAIMLPFVGGLIAQADTVLTRLEGSCRSDSLASHKCTTAIECRGFESILHVVVVKATIGCLIQLLLQQHKNEAAIFLVAGLALLEKIVAFVVDVDLADPQDQEAAYSECHEQFYHR

SEQ ID NO: 396 - DNA, 396 bp, Pseudomonas aeruginosa
tcctggggatcagccagatctacatcgacaacaaacgcaactatcttttccagcaaggccaggccggcaaccaggaaaatagccgcttcgttcttatgctgctgcagcaacaactggataagacagcctatcgtcgccttcacgacgacaacatggagaatgctttcaaatccgcgacattcaatggctgtcgtgcatttgtggctggcgagactatcgctgcggcaactgccctcaaggcgggtgagtacggtgtctgcttgcgctatcaacccgcctacaaaggggagcatgattgcctcggtaatgaaattaccggagttccggaaaagcccttcacaaatactccccctgtcgtcgttcgcctggtctacctaccgagcgccggtaccctga

SEQ ID NO: 397 - protein, 131 aa, Pseudomonas aeruginosa
SWGSARSTSTTNATIFSSKARPATRKIAASFLCCCSNNWIRQPIVAFTTTTWRMLSNPRHSMAVVHLWLARLSLRQLPSRRVSTVSACAINPPTKGSMIASVMKLPEFRKSPSQILPLSSFAWSTYRAPVP

SEQ ID NO: 398 - DNA, 306 bp, Pseudomonas aeruginosa
gttgcagtcgtcccgatatcgcccagtcgaaatcgggagaattggtcagtggtctcacagacttccgcttggaagcgggggtcgggccagcagatcgtagcgaacgcaaagtatccagcttcgtcgcactacaggatgtcgccggtcgtcctatccgagcattgcgcttctcaatcctggcaggcagcgacaatacaagcctgcgcacaggagatgatagccaggcacgcgatcgctggatcgtcctttatcccgagagcaaaagcgccatcgaggccgcagacaaaggccagatttaccaaatag

SEQ ID NO: 399 - protein, 101 aa, Pseudomonas aeruginosa
VAVVPISPSRNRENWSVVSQTSAWKRGSGQQIVANAKYPASSHYRMSPVVLSEHCASQSWQAATIQACAQEMIARHAIAGSSFIPRAKAPSRPQTKARFTK

SEQ ID NO: 400 - DNA, 630 bp, Pseudomonas aeruginosa
ccaaaccatcaggaatctcatgccatgaccctgcgccatacctctcgacagcagggatccacgttgttgatctcgctggttatcttgttgatgatcacgctcctcgccgtttccaacatgcgcgaggtgtcactggaaagccgtatcaccggcaatctcatcgaacagaagcgcctgcgcaatgcgggcgaagctgggctacgcgaaggtgaacgacgctttttcaataccatcaagcccccagaggtcggcagcggatgcgccgatagcaatgtcaaacggccttgcatactgaacctgagtgccctctccgtaccccgagatgacgtgcacaacaatccggtggcagccctgaacggcaagacagataacgccaattcacgtgtctggatgccctaccgaggcagcgatctgaataaccctacgcagatcgacaaagaccgcgcagtcacctggcagaccatcacggtgcccgctggcgaacagaacaacgaagcggaaaatcccgagtacggcaacatgatgcgcggggtcggcacgttctactacgaaaccaacagccgcgccctcaacaaggcgggcggagagactgttctacaggccgttcatgcacgcctgtataccaactga

SEQ ID NO: 401 - protein, 209 aa, Pseudomonas aeruginosa
PNHQESHAMTLRHTSRQQGSTLLISLVILLMITLLAVSNMREVSLESRITGNLIEQKRLRNAGEAGLREGERRFFNTIKPPEVGSGCADSNVKRPCILNLSALSVPRDDVHNNPVAALNGKTDNANSRVWMPYRGSDLNNPTQIDKDRAVTWQTITVPAGEQNNEAENPEYGNMMRGVGTFYYETNSRALNKAGGETVLQAVHARLYTN

SEQ ID NO: 402 - DNA, 378 bp, Pseudomonas aeruginosa
ggcatccagacacgtgaattggcgttatctgtcttgccgttcagggctgccaccggattgttgtgcacgtcatctcggggtacggagagggcactcaggttcagtatgcaaggccgtttgacattgctatcggcgcatccgctgccgacctctgggggcttgatggtattgaaaaagcgtcgttcaccttcgcgtagcccagcttcgcccgcattgcgcaggcgcttctgttcgatgagattgccggtgatacggctttccagtgacacctcgcgcatgttggaaacggcgaggagcgtgatcatcaacaagataaccagcgagatcaacaacgtggatccctgctgtcgagaggtatggcgcagggtcatggcatga

SEQ ID NO: 403 - protein, 125 aa, Pseudomonas aeruginosa
GIQTRELALSVLPFRAATGLLCTSSRGTERALRFSMQGRLTLLSAHPLPTSGGLMVLKKRRSPSRSPASPALRRRFCSMRLPVIRLSSDTSRMLETARSVIINKITSEINNVDPCCREVWRRVMA

SEQ ID NO: 404 - DNA, 3597 bp, Pseudomonas aeruginosa
tgcgcggggtcggcacgttctactacgaaaccaacagccgcgccctcaacaaggcgggcggagagactgttctacaggccgttcatgcacgcctgtataccaactgactggagccagcgcatgatccaccagattacccgcgcaggaaaaagcctgctggctgcaggttgcaccctgagcatcctgttcgcctctgacagttatgccgccacggccctgaatgtcagccagcaacccctgttcctaacccagggcgttgctcccaacctgctgttcactctagatgactcaggcagtatggcctgggcttacgtgcccgacggtattagcgggaatagcggcagagcgggacgttccagcgattacaacgcactgtactacaaccccgattatgcttaccaagtgcccaagaaattgacactgtcaggcgatcagatcatcgtttccgactatccagtgccacgcttcacagcagcctggcaggatggctacgcccaaggctccaccaccaacctgagcaataactatcgccctcaatggggaaccggctggcttggttgcatcgatagcagctgcaataccgggagagcttattactatacttataaggtaagcgctagctgccctgcacagccggtgagcagctccaactcctgttatacctacaatgctcttcctaccagtcaggaaagcaactttgcgatatggtactcctactatcgcaaccgcatcctggccacaaagaccgctgccaacctggccttttacagcctgccggaaaacgtgcgtctcacttggggggccctgaacacctgtagcatcggcgccaacagcagaagctgccaaaacaatgccctgctccaattcaacaagcagcacaaaatcaatttcttcaattggctggcgaacagcccggccagcggcggtactcctctgcatgcggctcttgaccgagccggacgcttcttgcaaaccaacggcacagcttataccaccgaagacggaaagacatattcctgccgggccagctatcacatcatgatgaccgacggtatctggaacggtcggaacgtcacccccggcaatctcgacaaccagaaccagacctttcctgatagcaccctctataggccacagcccccttatgccgacagcaatgccagctcattggctgacctggctttcaaatactggaccacagacttacgtcccagcatcgacaatgacctgaagcctttcatggcctacaagagtggggacgattccaaggattactgggaccctcgcaacaacccagccacttggcaacacatggtcaactttaccgttggcctaggtctttcctattcgctcacattgaactctgcaccaacttggacaggcagcacctttggcaactacgaggagttgatggctggaagcaaggcttggcccagcgtcgataacgacgccgcacccggtaacgtctacgacctctggcatgcagctatcaactctcgtggagacttctttagcgcggaatcaccggactctctggttcaggctttcaataagatcctgacacggatttccgagcgcaacacctcctcctccaaaccagcaatgacttccgcgctgcaggatgacggaaccggcgacaagctgatccgctacagctaccagtccagctttgccagtgacaagaactgggcgggcgaccttatacgttacaaggtggagtcgacttccaccggttcgaccaaaacccaggaatggagcgccggcgcactgctggacaaccgagctcccgctacccgtaatatttacatcgccagcaatagcggaaccaaccgccttaagcctttcacatggagcaatattgagggaagtcagttagccacttggctgaaccgcaacccggacaaggacaatcaggccgacaccaaaggagcacagcgggtcgacttcatccgtggccagcagaatatggatggattccggcaacgacaggcggtgttaggggacatcgtgcactcgtctccagccgtggtcggaccggcccaatacctcacttatctggccaaccccatcgaacccagcggcgactacggcacattcaagacagaggcagaccagcgcagccctagagtttatgttggatccaacgatggcatgttgcatggtttcaacatcaaaaccggcgtggaagagttcgctttcatccctacagcagtattcgaaaagcttaacaagcttaccggcatcagctaccagggcggtgcccaccaatatttcgtcgacgctacaccggtcgtcagcgatgcctttttcgatggagcttggcacactgttctgatcggaacgcttggtgctggaggtcgcggcctgttcgcactcgatgtaaccaagccggacgatgtcaagctgctttgggaatacgatagcagtaccgactcggaccttggttacaccttctccaaacctaccgtagccagactgcacagcggacaatgggcagtagttaccggcaacggctatggaagcgataatgacaaggcagctttactgctgattgatttgaaaaagggaacgctgatcaagaagctggaagtccaaagcgagcgcggaatagccaatggcctatcgacgcctcgcctggctgataacaacagcgatggcattgctgactacgcctatgctggcgatctgcagggaaatatctggcgcttcgatttgatcggcaatacccgcaacgacgacccagacacaaatacctctatcaatcccttcaagcccggagatgtagatccttctgctttcagagtatcgttcagcggcgccccgcttttccgtgctcgcgccgacaacaatactcgtcagcccatcacggctccgcctaccttggtacgccatcctagccgtaagggctacatcgtcatcgtaggtacaggaaaatacttcgaggacgatgacgctcaggccgataccagccgagccatgacgctctatggtatctgggatcgccagaccaagggcgaaagcgcaaacagtaccccaaccatcgaccgcaacgccctcacagcccaaaccatgacaacagaggcgaactccacattcggtagcgtgaacaggaatattcggcttattagccaaaacccggtgaagtggtacaaagacggagcaaccggtaccgcgaactcggatgtggctagctatggctggcgactgaatctggaggtcaatagcagcaagaaaggcgaaatgatgatcgaagatatgttcgctgccggccaagtgcttctattgcagaccttgacaccgaacgacgacccttgtgacagcggctctaccagctggacctacggcctcaatccatatactggcggacgtaccagtttcaccgtcttcgatctcaaacgtgcgggtatagtggactctggctcggattacaacggctcggtcgtatccgccttccaacaggatggactaggtggcttggccattacccagaacgaacagcgtcaatccgaggcttgcactggtgatgagtgcatcatcttcaaccccagcgacaagagtaacggacgacaaacctggcgggtcgtcgaggagaaatga

SEQ ID NO: 405 - protein, 1198 aa, Pseudomonas aeruginosa
CAGSARSTTKPTAAPSTRRAERLFYRPFMHACIPTDWSQRMIHQITRAGKSLLAAGCTLSILFASDSYAATALNVSQQPLFLTQGVAPNLLFTLDDSGSMAWAYVPDGISGNSGRAGRSSDYNALYYNPDYAYQVPKKLTLSGDQIIVSDYPVPRFTAAWQDGYAQGSTTNLSNNYRPQWGTGWLGCIDSSCNTGRAYYYTYKVSASCPAQPVSSSNSCYTYNALPTSQESNFAIWYSYYRNRILATKTAANLAFYSLPENVRLTWGALNTCSIGANSRSCQNNALLQFNKQHKINFFNWLANSPASGGTPLHAALDRAGRFLQTNGTAYTTEDGKTYSCRASYHIMMTDGIWNGRNVTPGNLDNQNQTFPDSTLYRPQPPYADSNASSLADLAFKYWTTDLRPSIDNDLKPFMAYKSGDDSKDYWDPRNNPATWQHMVNFTVGLGLSYSLTLNSAPTWTGSTFGNYEELMAGSKAWPSVDNDAAPGNVYDLWHAAINSRGDFFSAESPDSLVQAFNKILTRISERNTSSSKPAMTSALQDDGTGDKLIRYSYQSSFASDKNWAGDLIRYKVESTSTGSTKTQEWSAGALLDNRAPATRNIYIASNSGTNRLKPFTWSNIEGSQLATWLNRNPDKDNQADTKGAQRVDFIRGQQNMDGFRQRQAVLGDIVHSSPAVVGPAQYLTYLANPIEPSGDYGTFKTEADQRSPRVYVGSNDGMLHGFNIKTGVEEFAFIPTAVFEKLNKLTGISYQGGAHQYFVDATPVVSDAFFDGAWHTVLIGTLGAGGRGLFALDVTKPDDVKLLWEYDSSTDSDLGYTFSKPTVARLHSGQWAVVTGNGYGSDNDKAALLLIDLKKGTLIKKLEVQSERGIANGLSTPRLADNNSDGIADYAYAGDLQGNIWRFDLIGNTRNDDPDTNTSINPFKPGDVDPSAFRVSFSGAPLFRARADNNTRQPITAPPTLVRHPSRKGYIVIVGTGKYFEDDDAQADTSRAMTLYGIWDRQTKGESANSTPTIDRNALTAQTMTTEANSTFGSVNRNIRLISQNPVKWYKDGATGTANSDVASYGWRLNLEVNSSKKGEMMIEDMFAAGQVLLLQTLTPNDDPCDSGSTSWTYGLNPYTGGRTSFTVFDLKRAGIVDSGSDYNGSVVSAFQQDGLGGLAITQNEQRQSEACTGDECIIFNPSDKSNGRQTWRVVEEK

SEQ ID NO: 406 - DNA, 741 bp, Pseudomonas aeruginosa
gctggcattgctgtcggcataagggggctgtggcctatagagggtgctatcaggaaaggtctggttctggttgtcgagattgccgggggtgacgttccgaccgttccagataccgtcggtcatcatgatgtgatagctggcccggcaggaatatgtctttccgtcttcggtggtataagctgtgccgttggtttgcaagaagcgtccggctcggtcaagagccgcatgcagaggagtaccgccgctggccgggctgttcgccagccaattgaagaaattgattttgtgctgcttgttgaattggagcagggcattgttttggcagcttctgctgttggcgccgatgctacaggtgttcagggccccccaagtgagacgcacgttttccggcaggctgtaaaaggccaggttggcagcggtctttgtggccaggatgcggttgcgatagtaggagtaccatatcgcaaagttgctttcctgactggtaggaagagcattgtaggtataacaggagttggagctgctcaccggctgtgcagggcagctagcgcttaccttataagtatagtaataagctctcccggtattgcagctgctatcgatgcaaccaagccagccggttccccattgagggcgatagttattgctcaggttggtggtggagccttgggcgtagccatcctgccaggctgctgtgaagcgtggcactggatagtcggaaacgatgatctgatcgcctga

SEQ ID NO: 407 - protein, 246 aa, Pseudomonas aeruginosa
AGIAVGIRGLWPIEGAIRKGLVLVVEIAGGDVPTVPDTVGHHDVIAGPAGICLSVFGGISCAVGLQEASGSVKSRMQRSTAAGRAVRQPIEEIDFVLLVELEQGIVLAASAVGADATGVQGPPSETHVFRQAVKGQVGSGLCGQDAVAIVGVPYRKVAFLTGRKSIVGITGVGAAHRLCRAASAYLISIVISSPGIAAAIDATKPAGSPLRAIVIAQVGGGALGVAILPGCCEAWHWIVGNDDLIA

SEQ ID NO: 408 - DNA, 351 bp, Pseudomonas aeruginosa
ctgacttccctcaatattgctccatgtgaaaggcttaaggcggttggttccgctattgctggcgatgtaaatattacgggtagcgggagctcggttgtccagcagtgcgccggcgctccattcctgggttttggtcgaaccggtggaagtcgactccaccttgtaacgtataaggtcgcccgcccagttcttgtcactggcaaagctggactggtagctgtagcggatcagcttgtcgccggttccgtcatcctgcagcgcggaagtcattgctggtttggaggaggaggtgttgcgctcggaaatccgtgtcaggatcttattgaaagcctgaaccagagagtccggtga

SEQ ID NO: 409 - protein, 116 aa, Pseudomonas aeruginosa
LTSLNIAPCERLKAVGSAIAGDVNITGSGSSVVQQCAGAPFLGFGRTGGSRLHLVTYKVARPVLVTGKAGLVAVADQLVAGSVILQRGSHCWFGGGGVALGNPCQDLIESLNQRVR

SEQ ID NO: 410 - DNA, 546 bp, Pseudomonas aeruginosa
agctgccttgtcattatcgcttccatagccgttgccggtaactactgcccattgtccgctgtgcagtctggctacggtaggtttggagaaggtgtaaccaaggtccgagtcggtactgctatcgtattcccaaagcagcttgacatcgtccggcttggttacatcgagtgcgaacaggccgcgacctccagcaccaagcgttccgatcagaacagtgtgccaagctccatcgaaaaaggcatcgctgacgaccggtgtagcgtcgacgaaatattggtgggcaccgccctggtagctgatgccggtaagcttgttaagcttttcgaatactgctgtagggatgaaagcgaactcttccacgccggttttgatgttgaaaccatgcaacatgccatcgttggatccaacataaactctagggctgcgctggtctgcctctgtcttgaatgtgccgtagtcgccgctgggttcgatggggttggccagataagtgaggtattgggccggtccgaccacggctggagacgagtgcacgatgtcccctaa

SEQ ID NO: 411 - protein, 181 aa, Pseudomonas aeruginosa
SCLVIIASIAVAGNYCPLSAVQSGYGRFGEGVTKVRVGTAIVFPKQLDIVRLGYIECEQAATSSTKRSDQNSVPSSIEKGIADDRCSVDEILVGTALVADAGKLVKLFEYCCRDESELFHAGFDVETMQHAIVGSNINSRAALVCLCLECAVVAAGFDGVGQISEVLGRSDHGWRRVHDVP

SEQ ID NO: 412 - DNA, 336 bp, Pseudomonas aeruginosa
gggacatcgtgcactcgtctccagccgtggtcggaccggcccaatacctcacttatctggccaaccccatcgaacccagcggcgactacggcacattcaagacagaggcagaccagcgcagccctagagtttatgttggatccaacgatggcatgttgcatggtttcaacatcaaaaccggcgtggaagagttcgctttcatccctacagcagtattcgaaaagcttaacaagcttaccggcatcagctaccagggcggtgcccaccaatatttcgtcgacgctacaccggtcgtcagcgatgcctttttcgatggagcttggcacactgttctga

SEQ ID NO: 413 - protein, 111 aa, Pseudomonas aeruginosa
GTSCTRLQPWSDRPNTSLIWPTPSNPAATTAHSRQRQTSAALEFMLDPTMACCMVSTSKPAWKSSLSSLQQYSKSLTSLPASATRAVPTNISSTLHRSSAMPFSMELGTLF

SEQ ID NO: 414 - DNA, 660 bp, Pseudomonas aeruginosa
aagcacttggccggcagcgaacatatcttcgatcatcatttcgcctttcttgctgctattgacctccagattcagtcgccagccatagctagccacatccgagttcgcggtaccggttgctccgtctttgtaccacttcaccgggttttggctaataagccgaatattcctgttcacgctaccgaatgtggagttcgcctctgttgtcatggtttgggctgtgagggcgttgcggtcgatggttggggtactgtttgcgctttcgcccttggtctggcgatcccagataccatagagcgtcatggctcggctggtatcggcctgagcgtcatcgtcctcgaagtattttcctgtacctacgatgacgatgtagcccttacggctaggatggcgtaccaaggtaggcggagccgtgatgggctgacgagtattgttgtcggcgcgagcacggaaaagcggggcgccgctgaacgatactctgaaagcagaaggatctacatctccgggcttgaagggattgatagaggtatttgtgtctgggtcgtcgttgcgggtattgccgatcaaatcgaagcgccagatatttccctgcagatcgccagcataggcgtagtcagcaatgccatcgctgttgttatcagccaggcgaggcgtcgatag

SEQ ID NO: 415 - protein, 219 aa, Pseudomonas aeruginosa
KHLAGSEHIFDHHFAFLAAIDLQIQSPAIASHIRVRGTGCSVFVPLHRVLANKPNIPVHATECGVRLCCHGLGCEGVAVDGWGTVCAFALGLAIPDTIERHGSAGIGLSVIVLEVFSCTYDDDVALTARMAYQGRRSRDGLTSIVVGASTEKRGAAERYSESRRIYISGLEGIDRGICVWVVVAGIADQIEAPDISLQIASIGVVSNAIAVVISQARRR

SEQ ID NO: 416 - DNA, 327 bp, Pseudomonas aeruginosa
ccggcgagtcctgttgttggacacggttgggcaagcgatatgtctgcccatcgactactaccagaccggcggcaggatgaacatcctcgaccacgcccacattctcgaacgtattcgtggcactcaaggcaaaggttgggcaagccagagctagagctgcaagagctgtggcgagaagacgtaaggggttcatgttcatttctcctcgacgacccgccaggtttgtcgtccgttactcttgtcgctggggttgaagatgatgcactcatcaccagtgcaagcctcggattgacgctgttcgttctgggtaatggccaagccacctag

SEQ ID NO: 417 - protein, 108 aa, Pseudomonas aeruginosa
PASPVVGHGWASDMSAHRLLPDRRQDEHPRPRPHSRTYSWHSRQRLGKPELELQELWREDVRGSCSFLLDDPPGLSSVTLVAGVEDDALITSASLGLTLFVLGNGQAT

SEQ ID NO: 418 - DNA, 879 bp, Pseudomonas aeruginosa
gtggcttggccattacccagaacgaacagcgtcaatccgaggcttgcactggtgatgagtgcatcatcttcaaccccagcgacaagagtaacggacgacaaacctggcgggtcgtcgaggagaaatgaacatgaaccccttacgtcttctcgccacagctcttgcagctctagctctggcttgcccaacctttgccttgagtgccacgaatacgttcgagaatgtgggcgtggtcgaggatgttcatcctgccgccggtctggtagtagtcgatgggcagacatatcgcttgcccaaccgtgtccaacaacaggactcgccggtcatattcttggtacgtcagggacagacagtgtctttctccggcaaactcaccagcgacctgccagaaatcgagtcgttctacattatcaagcaggcccctctcgttcccttcggatcggagcagcaacaatgaagtcgaacagaggcttcactctcatcgagttgatgatcgtcgtagtaatcatcgctattcttgctggtatcgcctaccccagctacgacgaatacgtgaagcgcgggaatcgcaccgaaggacaggcattactcagcgaagcagccgctactcaagagcgctatttttcacagaacaatacttatatcactacccaagccgacatcggcaagctgcatatgcgcaacacatcgggcaccacagtgaagtcctccacaggcaaatacagccttaccgtcgatacggtagccaacgacggaggttatcgccttatcgctaaccaggcattcaacgatcttgattgtggcaacctgaccttgaccgccaacggcgagaaaggccggactggaagcaagaagagcgttgcagaatgctggcgctaa

SEQ ID NO: 419 - protein, 292 aa, Pseudomonas aeruginosa
VAWPLPRTNSVNPRLALVMSASSSTPATRVTDDKPGGSSRRNEHEPLTSSRHSSCSSSSGLPNLCLECHEYVRECGRGRGCSSCRRSGSSRWADISLAQPCPTTGLAGHILGTSGTDSVFLRQTHQRPARNRVVLHYQAGPSRSLRIGAATMKSNRGFTLIELMIVVVIIAILAGIAYPSYDEYVKRGNRTEGQALLSEAAATQERYFSQNNTYITTQADIGKLHMRNTSGTTVKSSTGKYSLTVDTVANDGGYRLIANQAFNDLDCGNLTLTANGEKGRTGSKKSVAECWR

SEQ ID NO: 420 - DNA, 366 bp, Pseudomonas aeruginosa
cggacgacaaacctggcgggtcgtcgaggagaaatgaacatgaaccccttacgtcttctcgccacagctcttgcagctctagctctggcttgcccaacctttgccttgagtgccacgaatacgttcgagaatgtgggcgtggtcgaggatgttcatcctgccgccggtctggtagtagtcgatgggcagacatatcgcttgcccaaccgtgtccaacaacaggactcgccggtcatattcttggtacgtcagggacagacagtgtctttctccggcaaactcaccagcgacctgccagaaatcgagtcgttctacattatcaagcaggcccctctcgttcccttcggatcggagcagcaacaatga

SEQ ID NO: 421 - protein, 121 aa, Pseudomonas aeruginosa
RTTNLAGRRGEMNMNPLRLLATALAALALACPTFALSATNTFENVGVVEDVHPAAGLVVVDGQTYRLPNRVQQQDSPVIFLVRQGQTVSFSGKLTSDLPEIESFYIIKQAPLVPFGSEQQQ

SEQ ID NO: 422 - DNA, 303 bp, Pseudomonas aeruginosa
agcctctgttcgacttcattgttgctgctccgatccgaagggaacgagaggggcctgcttgataatgtagaacgactcgatttctggcaggtcgctggtgagtttgccggagaaagacactgtctgtccctgacgtaccaagaatatgaccggcgagtcctgttgttggacacggttgggcaagcgatatgtctgcccatcgactactaccagaccggcggcaggatgaacatcctcgaccacgcccacattctcgaacgtattcgtggcactcaaggcaaaggttgggcaagccagagctag

SEQ ID NO: 423 - protein, 100 aa, Pseudomonas aeruginosa
SLCSTSLLLLRSEGNERGLLDNVERLDFWQVAGEFAGERHCLSLTYQEYDRRVLLLDTVGQAICLPIDYYQTGGRMNILDHAHILERIRGTQGKGWASQS

SEQ ID NO: 424 - DNA, 507 bp, Pseudomonas aeruginosa
tcgatgggcagacatatcgcttgcccaaccgtgtccaacaacaggactcgccggtcatattcttggtacgtcagggacagacagtgtctttctccggcaaactcaccagcgacctgccagaaatcgagtcgttctacattatcaagcaggcccctctcgttcccttcggatcggagcagcaacaatgaagtcgaacagaggcttcactctcatcgagttgatgatcgtcgtagtaatcatcgctattcttgctggtatcgcctaccccagctacgacgaatacgtgaagcgcgggaatcgcaccgaaggacaggcattactcagcgaagcagccgctactcaagagcgctatttttcacagaacaatacttatatcactacccaagccgacatcggcaagctgcatatgcgcaacacatcgggcaccacagtgaagtcctccacaggcaaatacagccttaccgtcgatacggtagccaacgacggaggttatcgccttatcgctaa

SEQ ID NO: 425 - protein, 168 aa, Pseudomonas aeruginosa
SMGRHIACPTVSNNRTRRSYSWYVRDRQCLSPANSPATCQKSSRSTLSSRPLSFPSDRSSNNEVEQRLHSHRVDDRRSNHRYSCWYRLPQLRRIREARESHRRTGITQRSSRYSRALFFTEQYLYHYPSRHRQAAYAQHIGHHSEVLHRQIQPYRRYGSQRRRLSPYR

SEQ ID NO: 426 - DNA, 414 bp, Pseudomonas aeruginosa
gtggggggcgtcggaagagcaggaactggagggacgggaggagaacattaccttctcgatgcccaaggaactgcgggtcaaggctttgtaatcggaatttttgcgcacctgaaaaagcccggcttatgccgggctttgcctttttcttgtctcggcgctttagcgccagcattctgcaacgctcttcttgcttccagtccggcctttctcgccgttggcggtcaaggtcaggttgccacaatcaagatcgttgaatgcctggttagcgataaggcgataacctccgtcgttggctaccgtatcgacggtaaggctgtatttgcctgtggaggacttcactgtggtgcccgatgtgttgcgcatatgcagcttgccgatgtcggcttgggtagtgatataagtattgttctgtga

SEQ ID NO: 427 - protein, 137 aa, Pseudomonas aeruginosa
VGGVGRAGTGGTGGEHYLLDAQGTAGQGFVIGIFAHLKKPGLCRALPFSCLGALAPAFCNALLASSPAFLAVGGQGQVATIKIVECLVSDKAITSVVGYRIDGKAVFACGGLHCGARCVAHMQLADVGLGSDISIVL

SEQ ID NO: 428 - DNA, 1050 bp, Pseudomonas aeruginosa
tcgacgtccagccggcctgaaccgtcggtcgctgcgcccttcccaagcggggagggcggtagcaaggttcattcgtccaatcaccgcgtcgcccacgagaccgccatgcaaatcaaactcgccaatccccgcggcttctgcgccggcgtggatcgcgccatcgagatcgtcaaccgtgccctcgatgtcttcggcccgccgatctacgtgcgtcacgaggtggtgcacaacaagttcgtcgtggacaacctgcgccagcgcggcgccatcttcgtcgaggaactcgatcaggtgccggacaacgtcatcgtcatcttcagcgcccacggcgtttcccaggcggtccgcaaggaagccgaggggcgcggcctgaaggttttcgacgcgacctgcccgctggtgaccaaggtgcacatggaagtggtgcgctacagccgcgacggccacgaatgcgtgctgatcgggcatgaaggccaccccgaggtggaaggcaccatgggccagtacgatgccagcaacggcggtgccatctacctggtggaggacgaggccgacgtcgccgcgctggaggtgcgcaagcccgaagccctgcactacgtgacccagaccaccctgtcgatggacgacacctcgaaggtcatcgatgccctgcgcgccaagttcccgcagatccaggggccgcgcaagaacgacatctgctatgccacccagaaccgccaggatgccgtgaaggaactggccgaccagtgcgacatggtcctggtggtgggcagccccaacagttccaactccaaccgcctgcgcgaactcgccgagcgcatgggcacgccggcctacctgatcgacggcgccgaggacatgcaacgcggctggttcgacggtgtgcgtcgcatcggaatcaccgcaggcgcctccgcgccggaagtgctggtgcgcggagtgatcgcccagctacgtgagtggggggcgtcggaagagcaggaactggagggacgggaggagaacattaccttctcgatgcccaaggaactgcgggtcaaggctttgtaa

SEQ ID NO: 429 - protein, 349 aa, Pseudomonas aeruginosa
STSSRPEPSVAAPFPSGEGGSKVHSSNHRVAHETAMQIKLANPRGFCAGVDRAIEIVNRALDVFGPPIYVRHEVVHNKFVVDNLRQRGAIFVEELDQVPDNVIVIFSAHGVSQAVRKEAEGRGLKVFDATCPLVTKVHMEVVRYSRDGHECVLIGHEGHPEVEGTMGQYDASNGGAIYLVEDEADVAALEVRKPEALHYVTQTTLSMDDTSKVIDALRAKFPQIQGPRKNDICYATQNRQDAVKELADQCDMVLVVGSPNSSNSNRLRELAERMGTPAYLIDGAEDMQRGWFDGVRRIGITAGASAPEVLVRGVIAQLREWGASEEQELEGREENITFSMPKELRVKAL

SEQ ID NO: 430 - DNA, 489 bp, Pseudomonas aeruginosa
aggccaccccgaggtggaaggcaccatgggccagtacgatgccagcaacggcggtgccatctacctggtggaggacgaggccgacgtcgccgcgctggaggtgcgcaagcccgaagccctgcactacgtgacccagaccaccctgtcgatggacgacacctcgaaggtcatcgatgccctgcgcgccaagttcccgcagatccaggggccgcgcaagaacgacatctgctatgccacccagaaccgccaggatgccgtgaaggaactggccgaccagtgcgacatggtcctggtggtgggcagccccaacagttccaactccaaccgcctgcgcgaactcgccgagcgcatgggcacgccggcctacctgatcgacggcgccgaggacatgcaacgcggctggttcgacggtgtgcgtcgcatcggaatcaccgcaggcgcctccgcgccggaagtgctggtgcgcggagtgatcgcccagctacgtga

SEQ ID NO: 431 - protein, 162 aa, Pseudomonas aeruginosa
RPPRGGRHHGPVRCQQRRCHLPGGGRGRRRRAGGAQARSPALRDPDHPVDGRHLEGHRCPARQVPADPGAAQERHLLCHPEPPGCREGTGRPVRHGPGGGQPQQFQLQPPARTRRAHGHAGLPDRRRRGHATRLVRRCASHRNHRRRLRAGSAGARSDRPAT

SEQ ID NO: 432 - DNA, 951 bp, Pseudomonas aeruginosa
ctgggcgatcactccgcgcaccagcacttccggcgcggaggcgcctgcggtgattccgatgcgacgcacaccgtcgaaccagccgcgttgcatgtcctcggcgccgtcgatcaggtaggccggcgtgcccatgcgctcggcgagttcgcgcaggcggttggagttggaactgttggggctgcccaccaccaggaccatgtcgcactggtcggccagttccttcacggcatcctggcggttctgggtggcatagcagatgtcgttcttgcgcggcccctggatctgcgggaacttggcgcgcagggcatcgatgaccttcgaggtgtcgtccatcgacagggtggtctgggtcacgtagtgcagggcttcgggcttgcgcacctccagcgcggcgacgtcggcctcgtcctccaccaggtagatggcaccgccgttgctggcatcgtactggcccatggtgccttccacctcggggtggccttcatgcccgatcagcacgcattcgtggccgtcgcggctgtagcgcaccacttccatgtgcaccttggtcaccagcgggcaggtcgcgtcgaaaaccttcaggccgcgcccctcggcttccttgcggaccgcctgggaaacgccgtgggcgctgaagatgacgatgacgttgtccggcacctgatcgagttcctcgacgaagatggcgccgcgctggcgcaggttgtccacgacgaacttgttgtgcaccacctcgtgacgcacgtagatcggcgggccgaagacatcgagggcacggttgacgatctcgatggcgcgatccacgccggcgcagaagccgcggggattggcgagtttgatttgcatggcggtctcgtgggcgacgcggtgattggacgaatgaaccttgctaccgccctccccgcttgggaagggcgcagcgaccgacggttcaggccggctggacgtcga

SEQ ID NO: 433 - protein, 317 aa, Pseudomonas aeruginosa
LGDHSAHQHFRRGGACGDSDATHTVEPAALHVLGAVDQVGRRAHALGEFAQAVGVGTVGAAHHQDHVALVGQFLHGILAVLGGIADVVLARPLDLRELGAQGIDDLRGVVHRQGGLGHVVQGFGLAHLQRGDVGLVLHQVDGTAVAGIVLAHGAFHLGVAFMPDQHAFVAVAAVAHHFHVHLGHQRAGRVENLQAAPLGFLADRLGNAVGAEDDDDVVRHLIEFLDEDGAALAQVVHDELVVHHLVTHVDRRAEDIEGTVDDLDGAIHAGAEAAGIGEFDLHGGLVGDAVIGRMNLATALPAWEGRSDRRFRPAGRR

SEQ ID NO: 434 - DNA, 321 bp, Pseudomonas aeruginosa
ccttcgaggtgtcgtccatcgacagggtggtctgggtcacgtagtgcagggcttcgggcttgcgcacctccagcgcggcgacgtcggcctcgtcctccaccaggtagatggcaccgccgttgctggcatcgtactggcccatggtgccttccacctcggggtggccttcatgcccgatcagcacgcattcgtggccgtcgcggctgtagcgcaccacttccatgtgcaccttggtcaccagcgggcaggtcgcgtcgaaaaccttcaggccgcgcccctcggcttccttgcggaccgcctgggaaacgccgtgggcgctga

SEQ ID NO: 435 - protein, 106 aa, Pseudomonas aeruginosa
PSRCRPSTGWSGSRSAGLRACAPPARRRRPRPPPGRWHRRCWHRTGPWCLPPRGGLHARSARIRGRRGCSAPLPCAPWSPAGRSRRKPSGRAPRLPCGPPGKRRGR

SEQ ID NO: 436 - DNA, 408 bp, Pseudomonas aeruginosa
caaggttcattcgtccaatcaccgcgtcgcccacgagaccgccatgcaaatcaaactcgccaatccccgcggcttctgcgccggcgtggatcgcgccatcgagatcgtcaaccgtgccctcgatgtcttcggcccgccgatctacgtgcgtcacgaggtggtgcacaacaagttcgtcgtggacaacctgcgccagcgcggcgccatcttcgtcgaggaactcgatcaggtgccggacaacgtcatcgtcatcttcagcgcccacggcgtttcccaggcggtccgcaaggaagccgaggggcgcggcctgaaggttttcgacgcgacctgcccgctggtgaccaaggtgcacatggaagtggtgcgctacagccgcgacggccacgaatgcgtgctgatcgggcatga

SEQ ID NO: 437 - protein, 135 aa, Pseudomonas aeruginosa
QGSFVQSPRRPRDRHANQTRQSPRLLRRRGSRHRDRQPCPRCLRPADLRASRGGAQQVRRGQPAPARRHLRRGTRSGAGQRHRHLQRPRRFPGGPQGSRGARPEGFRRDLPAGDQGAHGSGALQPRRPRMRADRA

What is claimed is:

1. A substantially pure polypeptide comprising an amino acid sequence that is substantially identical to the amino acid sequence of SEQ ID NO:107.

2. The substantially pure polypeptide of claim 1, wherein said amino acid sequence comprises the sequence shown in SEQ ID NO:107.

3. A method for identifying a compound which binds a polypeptide, said method comprising the steps of:
   (a) contacting a candidate compound with a substantially pure polypeptide comprising an amino acid sequence of claim 1 under conditions that allow binding; and
   (b) detecting binding of the candidate compound to the polypeptide.

4. A substantially pure polypeptide comprising an amino acid sequence that is substantially identical to the amino acid sequence of SEQ ID NO:108.

5. The substantially pure polypeptide of claim 4, wherein said amino acid sequence comprises the sequence shown in SEQ ID NO:108.

6. A method for identifying a compound which binds a polypeptide, said method comprising the steps of:
   (a) contacting a candidate compound with a substantially pure polypeptide comprising an amino acid sequence of claim 4 under conditions that allow binding; and
   (b) detecting binding of the candidate pound to the polypeptide.

* * * * *